United States Patent 11,141,474 (ARTIFICIAL NUCLEIC ACID MOLECULES ENCODING A NOROVIRUS ANTIGEN AND USES THEREOF) - sequence listing, part 19

SEQ ID NO: 39344 - RNA, 1602 nt, Artificial Sequence
  derived and/or modified sequence opt11 from VP1__Norovirus_and/or_Norovirus-like__JN183163
augaugauggccucaaaagacgccacccccuccgccgacggcgcaaccggcgcuggucagcuaguucccgaaguaaacacugcagaccccaucccaaucgaucccgucgccggauccucaaccgcccucgcaacagcaggccaggucaaccuuaucgacccguggaucaucaauaacuucguucaagccccacaaggcgaauuuacuaucucccccaacaacaccccaggagauguccucuucgaccuccaacucggcccccaccuaaacccauuccuaucacaccucucccaaauguacaauggcugggucggaaacaugagaguucgcgucguccuagcaggcaacgccuucaccgcuggcaaggucaucauaugcugcguacccccaggcuuccaaucccgcacccuaucaaucgcccaagccacccuguucccccacgucaucgccgacguccgcacacuagaccccgucgaagucccccuagaagacguccgaaacguccucuaccacaacaacgacacccaaccgacuaugcgccuccucugcaugcuauacaccccacucagaaccggaggcgccucuggaggcaccgacuccuucguaguagccgggcgaguacuuaccugccccggacccgacuucaacuuccucuuucucguucccccaacugucgaacagaaaacccgaccuuucaccguccccaacauaccccuaaaauaccuuucaaacucucgcauccccaaucccaucgaaggcaugucacucucccccgaucaaacucaaaauguucaauuccaaaacggccgaugcacaauagacggacaaccccucggcacuacaccagugucugucucacaacuaugcaaauuccgcggcagaaucaccuccggacaacgaguccucaaccuaaccgaacucgacggcucccccuucauggccuucgccgcacccgcccccgccggcuuccccgaccuaggcucaugcgacuggcacauagaaaugucaaaaauccccaacuccagcacccaaaacaacccaaucgucgucaauuccguaaaacccaacagccaacaauucguaccucaccucucaucaaucacccucgacgacaacgucucauccgguggcgacuacaucgguacaauucaauggaccagcccacccuccgacuccggaggcgcaaauaccaauuucuggaaaauacccgacuacggcagcucccucgccgaagccucacaacucgcacccgccgucuacccacccggauucaacgaagucaucgucuacuucauggccuccauccccggccccaaccaaucuggcuccccaaaccucguccccugccuccucccccaagaauacauaacccacuuuaucagugaacaagccccaauacaaggggaagccgcacuccuccacuacguagacccagacacaaaccgcaaccuaggcgaguucaaacucuaucccggcggcuaccuaaccugcguccccaacucaucauccacaggaccacaacaacucccccucgacggcguauucgucuucgccuccuggguaucgcgcuucuaucaacucaaaccaguuggaaccgcauaa

SEQ ID NO: 39345 - RNA, 1599 nt, Artificial Sequence
  derived and/or modified sequence opt11 from VP1__Norovirus_and/or_Norovirus-like__EU373815
augaaaauggccucaaacgacgccucacccuccuccgacggcuccgccaaccucguacccgaaaucaacaacgaagucauggcccucgaacccgucgcaggcgcagccaucgcugcucccgucgccggacaacaaaauaucaucgaccccuggauccgaaacaacuucguccaggcccccgggggcgaguucaccgucucaccccgcaacgcucccggagaaguccuccucaaccucccccucucccccgauauaaauccauaccucgcccaucuaucccgcauguacaacgguuacgccggcggcguagaaguagaaguagucuuagccggaaacgccuucacagccggaaaaaucaucuucgccgccgucccacccaacuuucccccagaaaaccuuuccccaucacaaaucaccaugcucccacacauaaucguagacgucagacaacuagaaccaguacgcaucccccucccagacgugcgcaacaacuucuaccacuacucccgugaaaacgauagcacccuacgccucguagccaugcucuacacaccacuccgagcaaacaaugccggcgacgacguauucaccgucagcugccgcguccuaacccgacccucccccgauuucgacuucaucuuccuaguacccccgaccgucgaaagcaaaucaaaacccuucacaauacccauccuuaccaucgaagaaaugaccaacucccgcuucccagccccacucgaaaugaugacaaccggccccucucaugacaucgucguccaaccccaaaauggacgaugcacgauugacggcguccuccuaggcaccacccaacuaucgcccgucaacaucugcucaaugcgcggaguccccaccaaacgcacgaacggcaccgauaacuguuucguccagcucgaaaacccaaacggcuccgccuacgaccccaccgaagauaucccugcaguccuuggaucaccagacuucguaggcgaguucuacgguaccaucacacaacgcuccccaaacaacucaacccgcgcacacccguucacccucaacaccggcuccccacgcuacacaccaaaaaucggcuccguagacauucacgucaccgacguagacgaccucaacgaucacgaacccgucaaacuaacucccgucggacucuccggcucauccggcucaauccaccaauggcaacuacccaacuacuccggcgucgcaacacacaacaugcaccucgccccaucagucgcaccccucuuuccaggagaacaaauccuauucuuuagauccaccguacccgguugcggcggcuaccccaauaccaacauagacugcuuaaucccccaagaauggguacaacacuuuuaccaagaaggagcccccgcacgaaccgacgucgcccuccuacgcuucaucaacccagacaccggacgaguacucuucgaaugcaaacuucacaagcacggcuucauaacugucgccuacuccggcaaccacgaccuagucaugccacccaacggcuacuuccgcuucgaaagcugggucaaccaauuccacacccuagcucccaugggaaccggcagagccgaagaauaa

SEQ ID NO: 39346 - RNA, 1599 nt, Artificial Sequence
  derived and/or modified sequence opt11 from VP1__Norovirus_and/or_Norovirus-like__KC473547
auggcaagcaaagaugcccccaccucacccgacggcgccucuggcgccggccaacucgucccagaagccaacaccgccgaacaaaucuccauggaccccgucgccggugcuucuaccgccgucgcaaccgcaggccaggucaacaugaucgacccauggauauucaauaacuucguccaagcaccccaaggugaauuuacuaucucccccaacaacaccccuggagacauccucuucgaccuucagcucggcccccaccuuaacccauuccucgcacaccuaucccaaauguauaacggcugggucggcaacaugcgcguacgcauccuccuugcgggcaacgccuucaccgccggaaaaaucaucaucugcugcguucccccaggcuucgaugccagaauccucacaaucgcccaagcaacacuauucccacaccucaucgccgacguccgcacacucgaacccgucgaacucccccucgaagauguccgcaacguccucuaccauaauucaucccaaccccaaccaaccaugagauuagucgccaugcucuacacaccacuccgaaccggcggcggauccggcgguacugacgccuucgucgucgccggacgcguccuuaccugccccgccccggacuucuccuuccuauuccuuguaccaccauccgucgaacagaaaacccgcgucuucuccguccccaacaucccacuaaaagaccuaucaaacucccgcgugcccgugcccauacaaggcauguucaugucccccgacgucaaccaaucaguccaauuccaaaacggccgaugccaaaucgacggccaacuacaaggaacgacgcccguaucacuuucccaacuaugcaaaauccgcggcaaaaccucauccaaugcacgagucuuaaaccuaucagaagucgacgggacacccuucauaccccucgaaucccccgcccccguuggcuuccccgaccucggcggaugcgacuggcacgucaacuucuccuuccagacccaagaccgcgaucccucucaaucugucaccuucgcaaccaacgacgccuccuucguuccauaccuuggcucagucucaccccacaacggcgaaggauuccaagcgggcgacaucaucggcagccucggcuggaucucggcaccaagcgacaauucacaauucaacguaugggcuauccccaaauacggcuccucacuccaaaugucaccaauccuacuccuucuaugcucaccccgacucugggaaguuauccucuacuucuacucuaccuuccccggcucuggccaacccucccaacuccaaguccccugccucuuaccccaagaguucauaacacacuucugcaaugaacaagccccaaucgccggugaagccgcucuacuccacuacguagauccagacacuggccgaaaccucggcgaguucaaacuuuacccagacggauucaugacaugcguccccaacucagucuccuccgguccacaaacccuccccaucaacggagucuucgucuucguauccugggucucucgcuucuaccagcucaagccagucggcaccgcaucugccgcccgucgacuauaa

SEQ ID NO: 39347 - RNA, 1599 nt, Artificial Sequence
  derived and/or modified sequence opt11 from VP1__Norovirus_and/or_Norovirus-like__GQ266692
augaaaauggccuccuccgacgccaaccccagcgacggcucaaccgccaaccucguuccugaggucaacaacgaagucauggcgcuagaaccagucguuggcgccgccaucgccgcccccgucgccggccaacaaaacgucaucgaccccuggauacgcaacaacuucguacaagcaccaggcggcgaguuuacuguaucucccagaaacgccccaggggaaauccuuuggucugcuccccucggccccgaccucaacccuuaccucucccaucucgcccgcauguauaacuccuacgccgguggcuucgaaguccaagucauccucgcaggcaacgccuucaccgcuggcaagaucaucuucgccgccguacccccaaacuuccccaccgaaggccucucccccucccaggucaccauguuuccccacauaaucgucgacguccgccaacuagaacccguccuaaucccacuacccgacguacgcaacaacuucuaccacuacaaccaaagcaaugaccccaccaucaaacucaucgcaaugcucuacacuccacuccgcgcaaacaacgccggagacgacguauucaccguauccugccgcguccuaacccgcccauccccagacuucgacuucauuuuccucguucccccaaccgucgaauccagaaccaaaccauucucagucccaauccucaccgucgaagagaugaccaacucacgcuuccccauaccccuugaaaagcuauucaccggccccuccuccgcauucgucguccagccacaaaacggacgaugcacaaccgacggugucuuacucggaaccacccaacucucccccgucaacaucugcaccuuccgcggcgacgucacacauauagccggaacccaagaauacaccaugaaccucgccucacaaaacuggaauaacuacgaccccaccgaggaaaucccagcuccacucggaacaccagacuuugucggaaaaauccaagguguccuaacccaaaccacccgucgcgacggcuccacacgcggccacaaagccaccguauccacaggauccguccaauucacccccaaacucggacgcauccaauucuccaccgacacuuccaacgacuuugaaacaggccagaacacacgauuuacaccagucggcguaguccaagacggaucgaccacccaccaaaacgaaccccaacaauggguccuccccaacuauuccggccgagacucccacaacguccaccuagccccagcugucgcccccucuuucccaggugaacagcuccuauucuuucgcuccacuaugcccggaugcagcggcuacccuaacaugaaccuagacugccuccucccccaagaauggguacaacacuucuaccaggaagccgcccccgcccaaagcgacgucgcccuucuacgcuucgucaacccagacacaggccgcgucuuauucgaaugcaaauuacacaaauccggcuacgucaccgucgcacacaccggccaacacgaccuugucaucccacccaacggauacuucagauucgacuccugggucaaccaauuuuacacccucgccuccauggccacauaa

SEQ ID NO: 39348 - RNA, 1599 nt, Artificial Sequence
  derived and/or modified sequence opt11 from VP1__Norovirus_and/or_Norovirus-like__GQ266693
augaaaauggcauccaacgacgcaaaccccuccgacggaucaaccgcaaaccuagucccagaggucaacaacgaagucauggcucuagaacccgucguaggggcagccaucgcagcccccgucgccggccaacagaacguaaucgaccccuggauacgcaacaacuucguacaagcacccggcggagaauuuaccgucagcccacgcaacgcccccggugaaauccucuggucugcaccccuaggacccgaccucaacccuuaccuaucccaccuggcccgcauguacaacucauaugccggcggauucgaaguucaagucauucuugccggcaacgccuucaccgccggcaaaaucaucuucgcugccguaccacccaacuuccccaccgaaggccuaucccccucucaagugaccauguucccccacaucaucgucgacguacgccaacucgagcccguccucaucccccuacccgacguccgcaacaauuucuaccacuacaaccaaagcaacgacccaacaaucaaacuaaucgccaugcuauacaccccgcuacgcgccaacaacgccggagacgauguguucaccgucuccugccgcguucucacccgaccaucuccugauuucgacuucaucuuccuaguacccccaacggucgaaucccgcaccaaacccuucagcguaccaauccuuaccgucgaagaaaugaccaacucccgauuccccaucccacuugaaaaacucuucaccggucccuccucaaccuucgucguccaaccucaaaacggccgcuguacaacagacggaguucuccucggcacaacccaacucucacccgucaacaucugcacauuccgcggcgacgucacacacaucgccucaaccagagucuacaccaugaaccucgccucccaaaacuggaacaacuacgaccccacugaagaaaucccagccccucuaggcaccccugauuucguaggcaaaauccaaggaguccucacacaaacaacccgcggggacggcagcacacgaggccacaaagccaccgucucaacaggcuccguggaguucacccccaaacuaggccgcauacaauucucaaccgacaccucaaacgacuucgaaaccggccaaaacaccagauucacacccgucggagucauacaagacggcaacaccacccaccaaaacgaaccucaacaaugggcccuccccaauuacuccggcucaggcucacacaacguccaccucgcccccgcagucgcaccauccuuccccggcgaacaauuacucuucuuccgcucaacaaugcccggcugcucuggcuacccaaacaugaaccucgaaugccuccuaccacaagaauggguccaacacuucuaccaagaagccgccccugcacaguccgacguagcacuacuccgauuugucaaccccgacaccggacgaguccucuucgaaugcaagcuccacaaauccggcuacgucacagucgcccacacaggccaacacgaccuaguaauacccccaaacgguuacuuccgauucgacuccuggaucaaccaguucuacacccuugcuucaauggccaccuaa

SEQ ID NO: 39349 - RNA, 1599 nt, Artificial Sequence
  derived and/or modified sequence opt11 from VP1__Norovirus_and/or_Norovirus-like__EU004673
augcguauguccgacggugccgcccccaaagcaucaggauccgaagcaucaggccaagaccucguccccacugccgucgaacaagccgucccaauacaacccgucgccggcgcagcacuggccgcacccgccgcagggcaaaucaaccaaaucgacccauggaucuuccaaaacuuuguccaaugcccccuuggagaauuuuccaucaguccccgaaacacccccggcgaaauacucuucgaccucgcccuuggccccggccuaaaccccuaccuagcccaccucuccgccauguacacaggcugggucggaaacauggaaguccaacucguccucgccggcaacgcuuucaccgcaggaaaggucguaguagcccuugugccacccuacuuccccaaaggcucacucacuacagcccaaaucacaugcuucccccacgucaugugcgauguacgcacccucgaacccauucagcuaccacuccucgauguccgccgaguccucuggcacgccacacaagaccaagaagaaucaaugagacuugucugcaugcuguacacaccacuacgcacaaacucccccggugaugaaucuuucguaguauccggacgccuacucuccaaaccagccgccgacuucaacuucgucuaccucacaccaccaaucgaacguacaaucuaccgaauggucgaccuccccguacuucaaccacgacucugcacccacgcaagauggcccgcccccguauacggacuccucguagaccccagccucccaucuaacccccaauggcaaaacggccgcguacacauagacggaacccuccuaggcacaacuccaguauccggcuccugggucuccugcuucgcagccgaagcugccuacgaauuucaaucgggcaccggagaagucgccacauucacccugaucgaacaagacggcuccgccuacgucccaggugaccgcgccgcaccccuuggcuacccagacuucuccggccaacucgaaaucgaaguccaaaccgaaaccacccgcgccggcgacaaacucaaaguaacaaccuucgaaaugauccuuggccccaccacaaacguagaccaagcgcccuaccaaggccgcgucuacgccagccuaacagccgccgccagccucgaucuaguagacggccgcguccgcgccgucccgcgcuccauauacuccuuccaagacguccugccagaauacaaugacggucuccuagucccacucgccccacccauagggcccuuccuccccggcgaaguacuccuacgcuuccgcacauacaugcgacaaguagacuccuccgacgccgcugcagaagcuauagacugcgcccucccacaagaguucguuucaugguucgccucaaacggcuucaccguccaauccgaagcccugcuacuccgauaccgaaacacccuaacaggccaacuccucuucgaauguaaacuuuacucugaaggauacauugcacucucauacuccgguucaggcccccucacguucccaaccgacggcuucuucgaaguuguaagcuggguaccucgauuauuccaacucgcaucggucggcuccuaa

SEQ ID NO: 39350 - RNA, 1599 nt, Artificial Sequence
  derived and/or modified sequence opt11 from VP1__Norovirus_and/or_Norovirus-like__AB601769
augcgaaugucagacggcgcagcaccaaaagccaacggguccgaagccuccggacaagaccucguccuaaccgccgucgaacaagccguccccauccaacccgucgcaggcgccgcacucgccgcacccgcggcaggacaaaucaaccaaaucgacccauggauauuccaaaacuucguucaguguccccucggcgaauuuuccauuucaccaagaaacacacccggcgaaauccucuucgaccucgcccuaggcccaggccuaaaccccuaccucgcccaccucuccgccauguacaccgguuggguaggcaacauggaaguacaacucguccucgccggcaacgcguucaccgccggcaaggucgucgucgcccuuguacccccguauuuccccaaaggcucacucaccaccgcccagaucaccuguuucccccacgucaugugcgacguacguacccucgaaccaauacaacuccccuuacucgacguucgccgaguccucuggcacgcgacucaagaccaagaagaauccaugcgacucgucugcaugcuauacacaccccuacgaaccaacucccccggcgaugaauccuucgucgucagcggaaggcuacuauccaaaccagccgcagacuucaacuucgucuaccucacacccccaaucgaacguaccaucuaccgcauggucgaccucccaguccuccaaccccgacucugcacccacgcacgcuggcccgccccuguauauggccugcuugucgaccccucccuacccuccaacccccaguggcagaacggccgaguccacgucgauggcacccuucucggaacaacacccgucuccgguucaugggucucuugcuucgccgcagaagccgcuuacgaguuccaaucaggcaccggcgaaguugccacauucacccucaucgaacaagacggcuccgccuacguacccggcgaacgagccgccccacucgguuaccccgacuucucaggccaacucgaaaucgaaguucaaaccgaaaccacaaaacgcggagaaaaacucaaagucaccacuuucgaaaugauccucggaccuacaaccaacguagaccaagcccccuaccaaggcagagucuacgccagccucucagcagcagccucccuggaccucgucgacggccgcguacgagcaguuccaagaucaaucuacggauuccaagacgucauaccagaauacaacgacggccuacucgucccccuagccccgccaaucggccccuuccucccaggagaaguacuccuccgcuuccgaacauacaugcgacaaguggacagcuccgacgcggcugccgaagccaucgacugcgcccucccccaggaauuuguaucgugguucgcuucaaacggauucaccguccaauccgaagcccuacuuuuacgcuaccguaacacacuuaccggacaauuacucuucgaaugcaaacuauacucagaaggauacauagcacucuccuauuccggcucagguccccucaccuucccuacugacggauucuucgaagucgucucuuggguuccacgucucuaccaacucgccucagucggauccuaa

SEQ ID NO: 39351 - RNA, 1599 nt, Artificial Sequence
  derived and/or modified sequence opt11 from VP1__Norovirus_and/or_Norovirus-like__EU004676
augcgcauguccgacggcgccgcacccaaagcaaacggauccgaagccucaggccaagaccucguccccaccgcagucgaacaagcuguccccauccaacccgucgccggagccgcccuagccgcccccgcggcaggucaaaucaaccaaaucgaccccuggaucuuccaaaacuucguacaaugcccacuuggcgaauuuuccaucucaccacgcaauaccccaggagaaauccucuucgaccuagcacuuggacccggacucaaccccuaccucgcucaccucucugccauguacacaggcugggucggcaacauggaaguacagcuagucuuagccggaaacgcauucacagccggcaaagucgucgucgcccuagucccacccuacuuccccaaaggcucccucaccacagcccaaauuaccugcuucccccacguaaugugcgacguacgcacccucgaacccauccaacucccacuccuagacguccgccgcguccucuggcacgcgacccaagaucaagaagaauccaugcgccucgucugcaugcuauacacaccccuccgcaccaacucacccggcgacgaauccuucguaguuuccggccgccucuuauccaaacccgccccagacuucaacuucgucuaccuaacaccacccaucgaacgaacuaucuaccgaauggucgaccuccccguccuacaaccccgacucugcacccaugcccgcuggccugcacccgucuacggacuccuaguagaccccucccucccauccaacccgcaguggcaaaacggccgaguucaaguagacggcacccuccuuggcacgacccccgucuccggaucaugggucucgugcuucgccgccgaagcagccuacgaauuucaagccggcacaggcgaagucgucaccuucacgaugaucgaacaagacggauccgccuacguaccaggcgaccgcgcagcaccccucggcuaccccgacuucagcggccaacucgaaaucgaaguacaaaccgaaacaaccaagaccggcgacaaacuccgagucacaacauucgaaaugauacucggccccacaaccaacguagaccaagccccuuaccaaggccgugccuacgccucccuaaccgccgcagccucccucgaccuaguugacggacgcguaagagcagucccccguuccaucuacuccuuccaagacgaacuaccagaauacaaugacggccuccuagucccccucgcucccccucucggccccuuccuccccggcgaaguacuacuccguuuccggacuuacaugagacaacuagacaccgccgacgccgccgcacaaccaauagacugcgcacucccccaagaguucaucucgugguucgcuucaaacaacuucaccguccaauccgacgcacuccuuguucgcuacagaaacacccugaccggccaauuacucuuugaagccaaacuauacuccgaaggcuacaucgccguauccuacucaggcucaggcccucuaacauucccuaccgacggauuuuucgaaguagucuccugggucccccgccucuuccaacuagccuccgucggcucauga

SEQ ID NO: 39352 - RNA, 1599 nt, Artificial Sequence
  derived and/or modified sequence opt11 from VP1__Norovirus_and/or_Norovirus-like__JQ237823
augcgcaugucugacggcgcggcccccaaagccaacggcucagaagcauccggacaagaccucgucccuaccgcaguagaacaggcaguucccauacagcccguagccggagcagcccuagccgcccccgcagcaggacaaaucaaucaaauugaccccuggaucuuccaaaacuuuguccaaugcccccucggagaguucagcaucucaccccguaacacccccggcgaaauacuauuugaccucgcccuuggccccggucucaaccccuaccuagcccaccucucagccauguacaccgguuggguaggcaacauggagguacaacuuguucucgccggcaacgcauucaccgcaggaaaaguagucgucgcccuagucccaccuuacuucccaaaaggaagccuaaccacagcacaaaucacgugcuucccucacgucaugugcgacguacgcacccuagagcccauacaacuaccacuccuugacguccgccgaguacuauggcacgccacccaagaccaagaagaaucaaugagacucgucugcaugcucuacacuccccuccgcaccaacuccccuggagacgaauccuucguugucuccggccgacucuuaucaaaacccgcccccgacuucaacuucgucuaccucaccccacccauagaacgcaccaucuaccggauggucgaucuacccguccuccaaccccgccucugcacucacgcacgcuggcccgccccaguuuacggacuccucgucgaccccucccuucccucaaacccccaauggcaaaacggccgcguccaaguagacggcacacuccucggaaccaccccagucucuggcucuuggguaagcugcuucgccgccgaagccgcauacgaguuccaagcaggcaccggcgaagucgucaccuucaccaugaucgaacaagacggcuccgccuacguacccggcgacagagccgcaccucugggauaccccgacuucuccggccaacucgaaaucgaaguacaaacagaaacaaccaaaacuggcgacaaacuucgagucacuaccuucgaaaugauccuuggacccaccacaaacgucgaccaagcacccuaccaaggacgcgccuacgccucccucacagcagccgccucacucgaccucgucgacggccgaguucgcgccgugccccgcucaauuuacucauuccaagacgaacuucccgaguacaacgacggcguccuaguaccgcuagcaccuccccuuggucccuuccuucccggcgaaguacuccuccgcuuccgaacauacaugagacaacucgauacagccgacgccgccgcccaacccauagacugcgcucucccucaagaauuuaucucaugguucgccuccaacaacuucaccguccaaucugacgcccuccuaguccgauaccgcaacacccuaaccggccaacuacuauucgaagccaaacuauacucagaaggcuacaucgccgucucauacuccggcucgggcccccucacauuccccaccgacggcuucuucgaaguagucucaugggucccccgacucuuccaacucgccagcgucggcucauaa

SEQ ID NO: 39353 - RNA, 1599 nt, Artificial Sequence
  derived and/or modified sequence opt11 from VP1__Norovirus_and/or_Norovirus-like__DQ223043
augcgcauguccgacggcgccgcccccaaagcuaacggcagcgaagccucaggccaagaccucguacccacagcagucgaacaagccgucccgauccaaccagucgccggagccgcccuagccgcucccgcagcuggccaaaucaaccaaaucgaccccuggaucuuccaaaacuucguacaaugcccccucggcgaguucuccaucuccccucgaaauacuccuggcgaaauccucuucgaccucgcccucggccccggucuuaacccauacuuagcccaccuuagcgccauguauaccgguugggucggaaauauggaaguccagcucguacucgccgguaaugccuucaccgcagguaaagucgucgucgcccuaguuccacccuacuuccccaagggcucccucaccacagcccaaauaaccugcuucccccacgucaugugugacgucagaacccuagaacccauccaacucccccuacucgacguacgccgcguccucuggcacgccacccaagaccaagaagaaucaaugcgccuagucugcaugcuauacacaccccuccgaaccaacucacccggugacgaauccuucgucguaucgggacgccuccucagcaaacccgcauccgacuucaacuucgucuacuuaaccccucccaucgaacgaaccaucuaccgcauggucgaccuacccguccuccagccccgacucugcacccacgcgcgcuggcccgccccaguuuacggacuccuagucgacccaucccuaccguccaacccacaauggcaaaauggccguguccacgucgacggcacucuacucgguaccacacccgucucaggcuccugggucuccugcuucgccgccgaagcagccuacgaguuccaaucuggaaccggcgaaguagccaccuucaccaugauagaacaagacgguuccgccuauguccccggagaccgcgccgcaccccucggcuaccccgacuucagcggccaacuagaaauagaaguccaaaccgaaacaaccaaaaccggcgacaaacucaagguaacaacauucgaaaugauccuaggcccaaccaccaacgucgaccaagccccauaccaaggccgugccuacgccucccuaacagccgcagccucacucgauuuaguagacggccgcguucgagccgucccccgaucagucuacuccuuccaagacgaacuacccgaauacaacgacggacuccuuguaccacuggcuccaccccucggacccuuccuucccggcgaaguucuacuccguuuccgcaccuacaugcgucaacucgacaccgccgacgccucagcccaacccauagacugcgcucucccccaagaguucauuuccugguucgcaucuaacaauuucacuguacaaucagacgcacuauuaguccgcuaccgcaacacccuaaccggacaacuccuuuucgaagcuaaacuauacuccgaaggcuacaucgccgucagcuacuccggcuccgguccgcuaaccuucccuacagacggauucuucgaagucguauccuggguuccacgucucuuccaacuagcauccgucggauccuag

SEQ ID NO: 39354 - RNA, 1599 nt, Artificial Sequence
  derived and/or modified sequence opt11 from VP1__Norovirus_and/or_Norovirus-like__JX048594
augcguaugucugacggcgccgcccccaaagccaacggcagcgaagcaucaggccaagaccuaguccccaccgcugucgaacaagcugucccuauucaaccuguagccggagcagcccucgccgcccccgcagccggccaaaucaaccaaauagaucccuggauuuuccaaaacuuuguacaaugcccccucggcgaauuuuccauaucaccccguaacacccccggcgaaauccucuucgaccuagcucuaggccccggccuaaaccccuaccuagcccaccucucagccauguacaccggauggguuggaaacauggaaguucaauuaguccucgccggcaacgccuucacagccggcaaggucgucgucgcccucgucccacccuacuuccccaaaggcucgcucaccacagcccaaaucaccuguuucccccacguaaugugugacguucgagcccucgaacccauacaacuaccacuccucgacguccgacgcguccucuggcacgccacccaagaucaggaagaauccaugcgucuaguaugcaugcuauacacaccacuacgcaccaacucccccggcgacgaauccuucgucguauccggucgacuacucucuaaaccagccgccgacuucaacuucgucuaccucaccccacccauugaacgcaccaucuaccgaauggucgaccuccccgucuuacaaccucgucuuugcacacaugcccgcuggcccgccccagucuacggccuccuagucgaccccucacuccccuccaacccccaauggcaaaacggacgcguccacguagacggaacccuucucggcaccaccccugucaguggcuccuggguuuccugcuucgccgccgaagccgcuuacgaauaccaaucagaagucggagaagucgccaccuucacccucaucgaacaagacggaucagcauacgucccaggagaccgagccgcaccgcucggauaccccgacuacuccggacaacuugaaaucgaaguacaaacugaaaccaccaaaaccggcgacaaacuaaaagucaccacuuucgacaugauccucggccccacuaccaacgucgaccaagucccuuaccagggcaaagucuacgcaucccuaacaaccgcaucaucccucgaccuuguugacggccgagcccgcgccguuccucguuccgucuacuccuuccaagacguccuccccgaauacaaugacggacuccuaguaccacuagccccaccccuaggccccuaccuaccaggcgaaguccuccuccgauuccgcacauauaugcggcaacucgacaccgccgacgcagccgcccaacccaucgacugcgcucugccccaagaguucaucuccugguucgccuccaacaacuucacaguccaaucagacgcccuucucauacgcuaccgcaauacccucacaggucaacuccuauucgaagcuaagcucuacuccgaaggcuacauugcuguaagcuacucaggcuccggaccccuuacauuccccacugacggauucuucgaagucgucuccuggguaccccgucucuuccaacucgccucuguaggcucuuaa

SEQ ID NO: 39355 - RNA, 1596 nt, Artificial Sequence
  derived and/or modified sequence opt11 from VP1__Norovirus_and/or_Norovirus-like__GQ266691
augaaaauggccagcucggacgccaaccccucggacggcuccacagcaucccuagucccggaaguuaacaacgaagucauggcacuagaacccgucgucggcgccgccaucgcagcccccgucgcaggccagcaaaacgucaucgaccccuggauucgcaacaacuuuguccaagcccccggaggagaauuuaccgucagcccccgcaacgccccaggcgaaauacucugguccgcuccccucggacccgaccuaaaccccuaccuuucccaccucgcccgaauguacaacgguuacgccggaggcuucgaaguacaggucauccucgccggaaacgcauucaccgccggcaaaaucaucuucgccgccguacccccaaacuucccaaccgaaggacucucacccucccaagucaccauguucccacauaucaucgucgacguccgccaacuugaacccguccucauuccgcuccccgauguccgcaacaacuucuaccacuacaaccaaagcaacgauccaaccaucaaacuaaucgccaugcuauacaccccacucagagcuaacaacgccggcgacgacguauucaccguaucaugcagaguccucacccgccccucacccgacuuugacuucaucuuccucgucccacccaccguagaaucacgaaccaaaccuuucuccgucccuauacuaaccauagaagaaaugaccaacucccgcuuccccaucccccucgaaaaacuauucacuggccccuccuccgccuuuguaguccaaccucaaaacggacgaugcacuaucgauggcguucugcucggaacuacacaacuaucccccgucaacaucugcacauucagaggcgacguaacccacaucgaaggcagcaaaguauacaccaugaaucuagcaucccaaaacuggaacaacuacgacccgaccgaagaaaucccggccccacucggcacccccgacuuuaaaggccgcauccaaggagugcuaacacaaacaacacgcuccgacggcucaaccagaggucauaccgccaccguauccaccggcuccgcagaguucaccccuaaacuaggccggauucaauucuccacggacaccaacaacgacuucgaaaccggacaaaacacuaaauucacccccgucggcgucguacaaaacggauccaccacccaccagaacgaaccccaacaaugggaacucccugauuauagcggacgaggcauccacaacguccaccuagcccccgccgucgcccccaccuaccccggagaacaaauccucuuuuuccgcuccacaaugcccggcugcuccggcuaccccaacaugaaccucgacugccuucucccccaagacuggguccgacacuucuaccaagaagccgcccccgcccaauccgacguagcccuccuaagauucgucaaccccgacaccggacgcguccucuucgaaugcaaacuccacaaaucagguuacgucacgguagcacacacaggccaacacgaccuagucaucccacccaacggauacuucagauucgacuccuggguuaaccaauucuauacacucgcccccaugggauaa

SEQ ID NO: 39356 - RNA, 1596 nt, Artificial Sequence
  derived and/or modified sequence opt11 from VP1__Norovirus_and/or_Norovirus-like__GQ266690
augaaaauggcuucauccgacgcaaaccccuccgacggcuccacagccaaccuagucccagaagucaacaacgaagucauggcacuagaaccggucgucggagccgcaauugccgcccccgucgcaggacaacaaaacguaaucgacccauggauccgaaacaacuucguacaggcccccggcggcgaguucaccgucuccccucgaaacgcacccggagaaauccuuuggucugcaccccucggacccgaccuaaaccccuaccucucccaccuagcaaggauguacaacucuuacgccgggggcuucgaaguccaagucauacucgcugguaaugcauucaccgccggcaaaauaauuuucgccgccguaccacccaacuuccccaccgaaggacucucccccucccaagucacuauguucccacacaucaucgucgacguccgacaguuagaacccguacuaauccccuuacccgacguccggaacaauuuuuaccacuauaaccagucaaaugacccgaccauuaaacucauagcaaugcuuuacacaccccuacgcgcaaauaacgccggcgacgacgucuuuaccguauccugccguguccucacccggccuucccccgacuuugacuucauauuccugguacccccaaccgucgaaucccgcacaaaaccuuucuccgucccaauccugaccgucgaagaaaugacaaacucccgauuccccaucccacuggaaaaauuauucaccggcccaucuucagcuuuuguaguccaaccucaaaacggacgcugcacaaccgacggaguccuccuaggcaccacccaacuuucacccgucaacaucugcaccuuccgcggcgacgucacccauauugcuggcacccaagaauacaccaugaaccuugccucccaaaacuggaacaacuacgaccccaccgaagagauccccgccccacucggcacccccgacuucguaggccgaauccaaggcguucucacccagaccacacgccgcgacggauccacccgcggacacaaagcaacugucucaaccggaucuguccacuucaccccuaaacucggacgcauacaguucucaaccgacacuuccaacgauuucgaaaccggacaaaauacaagauucacccccguaggagucguccaagacggcgguacuacccaccaaaaugaaccccaacaauggguacuccccaacuacuccggucgcgacggccacaacguacaccuagcaccagccgucgcaccauccuuccccggcgaacaaauccucuucuuccgauccacaaugccaggcugcuccggcuaucccaacaugaaccucgacugccuccucccccaagaauggguccaacacuucuaccaagaagccgcacccgcccaaucugacgucgcacuccuccgcuucgucaacccggacaccggccgcguccucuucgaaugcaaacuccacaaauccggcuacgucaccgucgcacacacaggccaacacgacuuaguaaucccaccaaacggcuacuuucgcuuugacucauggguaaaccaauucuacacccuagcgcccaugggauaa

SEQ ID NO: 39357 - RNA, 1596 nt, Artificial Sequence
  derived and/or modified sequence opt11 from VP1__Norovirus_and/or_Norovirus-like__JN183164
augaugauggccucaaaagacgcccccacaaacauggacggaacauccggcgccggacaacucguccccgaaguuuccacagccgaacccaucuccauggaacccgucgcaggcgcugcaaccgccgccgccaccgccggacaggucaacaugaucgacccguggaucaugucaaacuacguccaagcuccccaaggcgaauuuaccaucucgccuaauaacacaccaggcgacauacucuucgaccuccaacucggcccccaccuaaaucccuucuuaucacaccucgcccaaauguauaacggcugggucggcaacaugaaaguacgcgugcuacuugccggaaacgccuucacagccggaaagaucaucaucucaugcgucccacccggauucgccgcccaaaacgucucaaucgcccaagccaccauguucccccacgucauugccgacguccgcguccucgaacccauagaagucccccuagaagacguacguaauguacucuuccacaacaacgacucuacccccacaaugcgccucaucugcaugcucuauacaccccuccgcgccucuggauccucaucaggaaccgauccauucguaaucgcaggccgcguccucacaugccccuccccugacuucaacuuccucuuccucguaccacccaacguagaacagaaaacaaaacccuucuccguacccaaccucccacucaacguccuguccaacucacgcguacccucgcuuaucaaaucaaugauggucucgcaagaccacggacaaaugguccaauuccaaaacggacgagucaccuuagacggccaacuccaagguacaaccccuaccuccgccucccaacuaugcaaaauucgcggaaccgucuaccacgccaccggcggccaaggccucaaccucacagaaaucgacggaacccccuaucacgcauucgaaucccccgcccccaucgguuuccccgaccuaggcgaaugugauuggcacaucaacgccucccccgccaacgccuucaccgauggcuccauaauucaccgaauugacgucgcccaagacuccaccuuugcaccccaccucggcaccauccacuacaccaacgccgauuacaacgccaacgucggccucaucuguucucucgaauggcucucaccaccuucgggcggagcccccaaaguaaaccccugggccauccccagauacggcuccacccuuaccgaagccgcccaacuagccccaccuaucuacccacccggauucggcgaagccaucguauucuucauguccgacuuccccauagcaaacgguuccgacggacucuccguccccugcacaaucccacaagaauuuguaacccacuucguaaacgaacaagccccaacaagaggggaagcugcccuacuucacuacguagaccccgacacccaccgcaacuuaggcgaguucaaacuauacccagaaggcuucaugacaugcguccccaacuccuccggcuccggcccccaaacucuaccaaucaacggcgucuucacauucaucuccugggugucccgcuucuaccaacucaaacccgucggcaccuaa

SEQ ID NO: 39358 - RNA, 1596 nt, Artificial Sequence
  derived and/or modified sequence opt11 from VP1__Norovirus_and/or_Norovirus-like__AB809995
augaaaauggccucaaacgacgccgcacccucuaacgacggcgccgccucccuuguccccgaagcaauaaacgaaaccaugccccucgaaccagucgccggcgccuccaucgcugcucccgucgccggucaaaccaacaucauugaccccuggauacgcaccaacuucguccaagcccccaacggugaauuuacaguaucaccccgcaauuccccaggcgaaauccuccuaaaccuagaacucggcccagaucuaaaucccuaccuagcccaucuaucccguauguacaacggauaugccggcggcgucgaaguccagguucuccuggccggcaacgccuucaccgccggaaaaauccucuucgccgcuaucccacccaacuuccccgucgacaugauaucccccgcccaaaucaccaugcuuccccaccucauagucgacguccgcacgcucgaacccauuaugaucccccuucccgacguacgcaacguauucuaccacuucaacaaccaaccccaacccagaaugcgccucgucgccaugcucuacacaccccucagauccaacggauccggcgacgacgucuucacagucucuugccgcguucuaacacgccccacccccgacuucgaguucauuuaccucguaccucccuccgucgaaucuaagaccaaacccuucacacucccaauacucacaauauccgaacucacuaacucccgauucccuaucccuaucgaacaacuuuacacagcccccaacgaaaauaacgucguccaaugccaaaacggccgcugcacccucgacggcgaacuucaagguaccacccaacuucucuccucagccgucugcuccuaccgaggacgaacagucgccaacuccggcgacaauugggaccagaaccuacuacaacucaccuacccauccggcgccuccuacgaucccaccgacgaaguccccgcaccccuaggcacccaagacuuuuccggcauacucuacggcguccugacccaagacaaugucucagaagggacgggcgaagccaaaaacgccaaaggaguauacauauccaccacuuccggcaaauucacaccuaaaaucggauccauaggccuacacuccaucaccgaaaacguccacccaaaccaacaaagcagguucaccccagucggaguagcccaaaacgaaaacacccccuuccaacaauggguucucccccacuacgccggagcacucgcacuuaacacaaaccucgccccugcaguagccccaaccuuucccggcgaacaacuacucuucuuucgcagucgagucccaugcguccaaggucuacgcggccaagacgcauucauugacugucuccuaccgcaagaaugggucaaccacuuuuaccaagaagccgcccccucacaagcagacgucgcucuuauacgcuacgucaaucccgacaccggccguacacuauucgaagccaaacuccaccgcuccggcuucaucaccgucucccacaccggagccuacccacucguugucccucccaacggccauuuccgcuuugacagcugggucaaccaauuuuacucacucgcucccuaa

SEQ ID NO: 39359 - RNA, 1593 nt, Artificial Sequence
  derived and/or modified sequence opt11 from VP1__Norovirus_and/or_Norovirus-like__KT732275
augaaaauggccuccaacgacgccgcccccuccaacgacggcgcagcaggccucgucccagaaggcaacaacgaaacccuuccacuugaacccgucgcaggagccgcaaucgccgcuccugucaccggccaaaacaacaucaucgaccccuggauacgcaccaacuucguccaagcacccaacggcgaauuuacagucuccccacgcaacucacccggcgaaauccuacuaaaccuugaacucggacccgaccuuaaccccuaccuagcucaccugucacgaauguacaauggauaugccggcggugucgaaguccaaguccuccucgccggaaacgccuucaccgccggcaaaaucuuauucgccgcugucccacccaacuuccccguagaguuccuaucuccagcacaaauaacuaugcucccccaccucaucguagacguucggacacucgaacccaucaugaucccccuccccgacgucagaaacacauuuuuccacuauuccaaccaacccaacucccgcaugcgccuagucgccaugcuuuauacaccccuacgauccaacgguuccggggacgacguuuucaccguaucaugucgcguccucacccgcccaacccccgacuucgaguucaccuaccuagucccacccucuguugaaucuaaaaccaagcccuucucgcucccaauccucacccucuccgaacuaaccaacuccagauucccugucccaauugacucucucuucaccgcccaaaauaacguacuacaagugcaaugccagaacggccgaugcacccucgacggagaauuacaagggaccacacaacuccuacccucaggcauuugcgcuuuccgcggacgcgucaccgcacaaaucaaccaacgagaccguuggcacaugcaacuucaaaaccucaacggcaccaccuacgacccaaccgaugacgucccagccccacucggcacccccgacuucaaaggcgucgucuucgguauggucucucaacgcaacguaggcaacgacgccccgggcuccacacgcgcccaacaggcuuggguuuccaccuacuccccucaauucguccccaaauuaggauccguaaaccuccgcauaucagacaacgacgacuuccaauuccaacccaccaaauucacccccgucggcguuaaugaugacgacgacggccaccccuuccgacaaugggaacuaccaaacuauagcggcgaacuaacucuaaacaugaaucuagcucccccaguugccccaaacuucccuggagaacaacuccuauucuuccgcaguuucguaccaugcuccggcggcuacaaccaaggcauaaucgacugccucaucccccaagaauggauccaacacuucuaccaagaauccgcccccucccaauccgacgucgcacucauccgcuacgucaaccccgacaccggaagaacccucuucgaagccaagcuccaccgauccggguacaucacagucgcacacuccggcgacuacccccuagucgucccugcaaacggccacuuccgauucgacucauggguuaaccaauucuacucccucgccccgauguaa

SEQ ID NO: 39360 - RNA, 1593 nt, Artificial Sequence
  derived and/or modified sequence opt11 from VP1__Norovirus_and/or_Norovirus-like__AB809998
augaaaauggccucuaacgacgccgcucccuccaaugacggcgccgcaucacuuguccccgaagccaucaaugaaaccaugccccuagaacccgucgcgggcgccuccauagccgccccugucgcaggccaaacaaacaucauagaccccuggauacgaaccaacuucguccaagcuccuaacggugaguucaccgucucaccccggaacuccccuggcgaaauccuccugaaccuagagcucggucccgacuuaaaccccuaucuggcacaccucucccgcauguacaacggcuaugccggcggcgucgaaguccaaguucuccuagccggcaacgcauucaccgccggcaaaauucuuuucgccgccaucccacccaacuuccccguagacaugaucucccccgcucaaaucaccaugcuaccucaccugaucgucgacguccgcacccuagaacccaucaugaucccccucccugauguacgaaacgucuucuaccacuucaauaaccaaccucaacccagaaugcgauuagucgcaaugcuuuacacaccccuccgauccaacggcucaggcgaugacgucuucaccgucucaugccgcguccucaccagaccaacccccgacuucgaauuuauauaccucgucccacccuccgucgaauccaaaaccaaacccuucacucuacccauccucaccauauccgaacuuacaaacucccgcuucccuauccccaucgaacagcucuacaccgcacccaacgaaaacaacgucguccaaugccaaaacggccgcugcacccucgacggcgaacugcaaggaaccacucaacuacuaucuucagccgucugcucauaccgaggacgcacugucgcaaacuccggcgacaacugggaccaaaaccuacuccaacuuaccuacccauccggagcuucauacgacccuacagacgagguccccgcaccccuaggaacccaggacuucuccggcauccucuacggcguccuaacccaagacaacgucucagaagccaccggcgaagccaaaaaugccaaaggugucuacauauccacaacauccggcaaauucacacccaagauuggcuccauaggccuccacucaaucacagaaaacguucaucccaaccaacaauccagauucaccccagucggcgucgcccaaaacgaaaacacccccuuccaacaauggguacucccucacuacgccggcgcccuagcacuuaacacaaaccucgcacccgccgucgcaccaaccuucccaggcgaacaacuccucuucuuccgaucacgcguccccugcguccaaggccuucgcggccgcgacgccuucaucgacugccuccucccacaagaauggguaaaccacuucuaccaagaagccgccccaucccaagcagacgucgcccugauacgcuacguaaaccccgacaccggacgaacucuuuuugaagccaaacuacaccgauccggcuucauaaccgucagccacaccggagccuauccccucguuguacccccaaacggccacuuccgauuugacuccugggucaaccaauucuacucauuagcuuaa

SEQ ID NO: 39361 - RNA, 1593 nt, Artificial Sequence
  derived and/or modified sequence opt11 from VP1__Norovirus_and/or_Norovirus-like__AB809984
augaaaauggccuccaacgacgcagcucccucaaacgauggagcugcuagccucguccccgaagccauaaacgaaacaaugccacucgaacccguagcaggcgccucaauugcugcacccgucgccggccagaccaacaucauagaccccuggauccgcacaaacuucguccaagcacccaacggcgaauuuaccgucucuccccgcaauucccccggugaaauccuacuaaaccucgaacucggccccgaccucaaccccuaccucgcccaccucucccgaauguauaacgguuacgccggcggcguagaaguccaaguccuucucgcaggcaacgccuucacagccggcaagauucucuucgcagccaucccacccaacuuucccguagacaugauuucucccgcccaaaucaccaugcucccccaccucaucgucgacguacgcacacucgaacccaucaugaucccccuacccgacgucagaaacgucuucuaccacuucaacaaccaaccccaaccacgcaugcgccucgucgcaaugcucuacacuccccuccgguccaacggcagcggagacgacguauucaccgucuccugccgcguacucaccagacccaccccagauuucgaguucauuuaccucgucccacccucaguagaaucaaaaaccaaacccuucacucuacccauccucacuauuucugaacucacaaacucccgcuuccccauccccaucgaacaacuauacacugcccccaacgaaaacaacgucguccaaugccaaaacggccgaugcacccucgauggcgaacuacaggguacaacccaacuccucucauccgccgucugcucauaccgcggaagaacaguagccaauuccggcgacaacugggaccaaaaccuucuccaacuaacauaccccagcggugccucauaugacccuaccgacgaaguccccgccccacucggaacacaggacuucuccggcauccucuacggaguacucacucaagacaacgucagugaaggaaccggcgaagccaaaaacgcuaaaggugucuacaucagcaccaccuccggcaaauucacccccaaaaucggcuccaucggacuucacuccaucacagaaaacguccacccaaaccaacaaucccgauucacccccgucggcgucgcacaaaacgaaaauacccccuuccaacaauggguccucccccacuacgccggagcccucgcucucaacaccaaccucgcccccgcagucgcccccaccuuccccggcgaacaacuccuuuucuuccgcucccgcguccccugcguccaaggccuccgcggccaagacgcauucauagacugucuacucccccaagaaugggucaaccacuucuaucaagaagccgcaccaucccaagccgacguugcccuuauccguuacgucaaucccgacacuggccgcacccucuucgaagccaaacuccaccgcagcggcuucaucacgguaucacacacuggagcauauccacucguagucccucccaacggccacuuccgcuucgacuccugggucaaccaauucuacucacucgcauaa

SEQ ID NO: 39362 - RNA, 1590 nt, Artificial Sequence
  derived and/or modified sequence opt11 from VP1__Norovirus_and/or_Norovirus-like__KT732276
augaaaauggccucaaacgacgccgcaccuuccaacgacggcgcagccggcuuaguaccagaaggcaacaacgaaacacucccacuugaacccgucgcaggggccgccaucgccgccccugugacuggccaaaacaacaucaucgacccguggauccgcaccaacuucguacaagccccaaacggagaauuuacugucucccccagaaacucccccggcgaaauccuccucaaccucgaacuaggaccggaccuaaaccccuaccucgcccaccuuucccgcauguauaacggcuacgcaggcggcgucgaaguucaaguccuccucgcaggcaacgccuucaccgccggcaaaauccuauucgccgccguaccgcccaacuuccccguagaauuucuaucccccgcccaaaucacaaugcuuccccaccucaucgucgacguccgaacucucgaacccaucaugauaccccuccccgacguccgcaacaccuucuuccacuacucuaaccaacccaacucucgcaugcgccuuguugccaugcucuacaccccacuccgcucaaacggcucaggcgacgacgucuucacagucuccugccgaguccuaacccgacccaccccagacuucgaguucaccuaccucgucccacccucaguagaaucuaaaacaaaaccuuucucccuacccauccuuaccuuauccgaacucaccaacucccgcuucccugucccaaucgacucucucuucaccgcccaaaacaacguacuacaaguccaaugccaaaacggacgaugcacccucgauggcgaauuacaaggcaccacccaacuacuccccucagguaucugcgccuuccgaggccgcguaacugcucaaaucaaccagcgagaccgcuggcacaugcaacuucaaaaccucaacggaaccaccuacgaccccaccgacgacguccccgcaccccuuggcacccccgacuucaaaggaguuguauucggcaugguuucgcagcguaacgugggcaacgacgccccagguuccacccgcgcacaacaagcauggguaucaaccuauucaccgcaauucguccccaaacucggcucugucaaucuccgcaucucagacaacgacgacuuccaauuccaacccaccaaauucacacccguaggcgucaacgacgacgacgacggccaccccuuccgacaaugggaacuccccaacuacucaggcgaacuaacacucaacaugaaccucgccccacccgucgccccaaacuucccaggcgaacaacuccuuuucuuucgcagcuucguacccugcucaggaggcuacaaccagggcaucauagacugccucaucccccaagaauggauccaacauuucuaccaagaauccgcccccucccaauccgacguagcccuaauuagauacgucaaccccgauacaggccggacccucuucgaagccaaacuccaccgcucuggauacaucaccgucgcucacucgggcgacuacccacucgucguucccgcuaauggccacuuccguuucgacucaugggucaaccaauucuacucccuagcccccuag

SEQ ID NO: 39363 - RNA, 1590 nt, Artificial Sequence
  derived and/or modified sequence opt11 from VP1__Norovirus_and/or_Norovirus-like__AB810009
augaaaauggccuccaacgacgccgcccccucaaacgacggcgccgccucccuaguccccgaagcaauuaacgaaaccaugccccucgaacccgucgccggagcaucaaucgccgcccccgucgccggccaaacaaacaucauugauccauggauccgaaccaacuucguccaagcccccaacggcgaauuuaccgucucaccacgaaacucccccggcgaaauacuacucaaccucgaacuuggaccagaccucaaccccuaccucgcccaccucucacgcauguacaacggauacgccggcggcguagaaguacagguccuccucgccgguaacgcauucaccgccgguaaaauacuauuugcagccaucccucccaacuuccccgucgauaugaucucccccgcucaaaucaccaugcucccccaccucaucguagacguccgcacacucgaacccaucaugauaccacucccagacguccgcaacgucuucuaccacuucaacaaccaaccccaaccccgcaugcgccuagucgccaugcucuacaccccacuccgcuccaacggcuccggcgacgacgucuuuaccgucuccugccgcguacucacccgccccaccccugacuucgaguucaucuaccuagucccacccucuguugaaucaaaaacaaaacccuucacucuccccauucuaaccaucuccgaacuuaccaauucccgauuucccauccccaucgaacaacuuuacacugcccccaaugaaaacaacguuguccaaugccagaacggccgaugcacacuggacggcgagcuccaagguacaacccaacuccucagcucggcagucuguuccuaccgcggacguaccgucgccaaccgcggcgacaacugggaucaaaaccuccuccaacucaccuaccccuccggcgccucauacgaucccaccgacgaaguccccgcaccucucgguacccaagacuucuccggcauacuuuacggcguccuaacccaagacaacgucucugaagguaccggagaagccaaaaacgcaaaaggcgucuauaucucaaccaccuccggaaaauucacaccaaaaaucggcucaaucggucuccacuccauaaccgaaaacguucaccccaaccaacaaucccgcuucacacccguaggcgucgcacaaaacgaaaacaccccauuccaacaauggguccucccgcacuaugccggugcacucgcccuuaacacuaaccuagcacccgccgucgcccccaccuuccccggagagcaacuccucuuuuuccgcucccguguccccugcguccaaggccuccgcggccaagaugcuuucaucgacugccuacuuccgcaagaaugggucaaccacuuuuaccaagaggcagccccaucacaggccgacgucgcccuuauccgguacgucaaccccgauaccggcagaacgcuauucgaggcuaaacuccaccgcuccggcuuuaucacagucucccacacgggcgcuuacccccucguuguacccccaaacggccacuuccgauuugacuccugggucaaucaauucuacucacuuuaa

SEQ ID NO: 39364 - RNA, 1590 nt, Artificial Sequence
  derived and/or modified sequence opt11 from VP1__Norovirus_and/or_Norovirus-like__KM461690
augaaaauggccucaagcgaugccgcccccuccaacgacggcgcugccaaccucguaccagaagcgaauaacgaagucauggcccuugaaccuguagucggcgcuucaauagccgccccagucgucggacaacaaaacaucaucgaccccuggauccgugaaaacuuuguccaagcaccacaaggcgaguucaccgucucaccccguaacuccccaggcgaaaugcuucucaaccuagaacucggccccgaacucaacccuuaccucucccaccucuccagaauguacaacgguuacgcaggcggaaugcaaguccaaguuguccucgccggcaaugccuucaccgcaggcaaaaucaucuucgccgcaguuccaccccacuuccccgucgaaaacaucucugccgcacaaauaaccaugugcccccauguaaucgucgacguccgccaacucgaacccguacuacuaccccuucccgacauacguaaccgcuucuuccacuacaaucaagaaaacacaccgcgcaugcgccucgucgccaugcucuacaccccacuccgcgcaaauucaggagaagacguauucacaguauccugccgcguccuuacccgccccgcucccgacuucgaguucacuuuccucguacccccaaccgucgaaucaaaaaccaaaccauucacccucccuauccucacccucggagaacuaucuaacucccgcuucccugccccaaucgacaugcuauacaccgaccccaacgaaggcauagucguccagccccaaaacggucgcugcacacucgauggaacccuccaaggcaccacucagcuaguaccaacucaaauaugugccuuccgcgguacccuuaucggccaaacaucccgauccagcgacucgacagacucagcuccccgccgucgagaccacccccuccacguucaacucaaaaaccuugacggcacccaauacgaccccacagacgaagucccagcaguccucggagccauugacuucaaaggaaccgucuuuggcguagccucccaacgagacgucuccggccaacaaguaggcgcaacccgcgcucacgaaguccacaucaacaccaccgacccccgcuacacccccaaacucggcuccauccucaugcacagcgaauccgacgacuucgucaccggacaaccaguuagguucaccccaaucggcaugggcgauaacgacuggcaccaaugggaacuaccagacuacuccggacggcucacccucaacaugaaccucgcacccgcugucgcccccgccuucccaggcgaacgcaucuuauucuuccgaucaaucguucccuccgcaggcggauacggcagcggucaaaucgacugccucauaccccaagaauggguccaacacuucuaccaagaagcugcccccucccaauccgcagucgcccuuauccgcuacgucaaccccgacaccggcagaaacaucuucgaagcaaaacuccaccgcgaaggcuucauaaccguugcaaacuccggcaacaaccccaucgucguaccaccaaacggcuauuucagauucgaagccugggucaacuaa

SEQ ID NO: 39365 - RNA, 1587 nt, Artificial Sequence
  derived and/or modified sequence opt11 from VP1__Norovirus_and/or_Norovirus-like__JN400618
augaaaauggccucaagugacgccaaccccuccgacggcucuaccgcaaaccuuguccccgaaguaaacaaugaaguaauggcuuuagaaccagucgucggcgcugccaucgccgcacccgucgccggccaacaaaacguaauugaccccuggauccgaaacaacuucguucaggccccaggaggugaguucaccgucucaccccgcaacgcccccggcgaaauccuaugguccgcaccccucggccccgaccucaaucccuaccucucacaccucgcucgcauguacaacggcuaugccggcggcuucgaaguccaaguaauccucgcaggcaacgccuucaccgccgguaaaaucaucuucgccgcaguacccccaaacuuccccaccgaaggccucucccccucacaagucaccauguucccccacaucaucgucgacguccgccaacuugaaccagugcucaucccacuucccgacgucagaaacaacuucuaccacuacaaccaaagcaacgacucaaccauaaaacuaaucgcaaugcucuacaccccacuccgagccaacaacgcaggagacgaugucuucaccguuucaugcagaguacucacccgccccuccccacgcuucgaaucccgaaccaaaccuuucuccguaccuguucuaaccgucgaagaaaugaccaacucccgcuucccuauaccucucgaaaaacuauucaccggccccucauccgcuuucguaguucaaccccaaaacggccgcugcaccacagacggcguacuucuuggcacuacccaacuaucccccgucaacaucugcaccuuccgcggcgacgucacacacauuccagguucacguaacuacacaaugaaccucgccucccaaaacuggaacucuuacggucccacagaagaaaucccugcaccccucggcacccccgacuucgucggcaaaauccagggcguacucacucaaaccacgcgaaccaacggauccacccguggacacaaagccacgguuuacacuggaagcgcagacuucucccccaaacuaggaagaguacaauucgccacugacacugacaacgacuucgaaacaaaccaaaacacuaaauucacacccgucggaguaauccaagacggcucgaccaccccacgcaacgaaccacaacaauggguccuacccuccuauuccggucggaacauccacaacguacaccuugcccccgccguagcccccaccuuccccggcgaacaacuccucuucuuccgauccaccaugccaggcugcucaggcuaucccaacauggaucucgacugccuccucccccaagaauggguccaauacuuuuaccaagaagccgcccccgcacagucagacguagcccuccuccgcuucgucaaccccgacaccgggcgaguacuauucgaaugcaaacuccacaagagcgguuacgucaccgucgcacacacuggccaacacgaccucgucauaccacccaacggauacuuccgcuucgacucaugggucaaccaauucuacacacucgcccccaugggcaacggcacaggccgccgccgcuaa

SEQ ID NO: 39366 - RNA, 1587 nt, Artificial Sequence
  derived and/or modified sequence opt11 from VP1__Norovirus_and/or_Norovirus-like__JQ653095
augaaaauggccuccaacgacgccgcccccuccaacgacggugccgccggucucgucccagaagucaacaacgaaaccauggcccucgagcccgucgccggagcaagcauagcagcaccccucaccggccaaaauaacgucaucgaccccuggauccgccucaacuucguucaagcccacaacggcgaguucaccgucucucccagaaauucucccggugaaguccuacucaaccuagaacucggccccgaacucaacccauaccucgcccaccucucccgcauguacaacgguuacgcaggcggcguagaaguccaaguacuccuagccggaaacgcauucacugccggaaagcuaguauucgcagcugucccaccccacuucccccucgaaaacauaucgcccggccaaaucaccauguuuccccacgucauuauagacguacguacacuagaacccguccuccucccucuacccgacguccgcaacaacuucuuccacuacaaccaacaaaacgaacccagaaugcgccuagucgcaaugcucuacacaccccuacgauccaacggcagcggcgacgacguuuucaccgucucaugccgggucccuacccgccccucacccgacuucgacuucaacuaucuagucccacccaccgucgaaucuaaaaccaaacccuucacccuccccauccuaaccaucggagaacucaccaacucccgcuucccugugcccaucgacgaacuuuacacaucaccaaaugaaucucuaguaguacaaccccaaaacggacgcugcgcccucgacggcgaacuccaaggcaccacccaacuacucccaaccgccauaugcucauuccgcggccgaauaaaccaaaaaguaucaggagaaaaccacgucuggaacaugcaggucacaaacaucaacggcacaccauuugaccccacugaagacguuccggcaccccuuggcacacccgacuucucaggaaaacucuucggcguucuaucacaacgcgaccacgacaacgccugccgcucccacgacgccgucauagccaccaauuccgccaaauucaccccaaaacucggcgccauccaaaucggcaccugggaacaagacgacguccauaucaaccaacccaccaaauucacccccguaggccucuucgaguccgaaggcuucaaccaauggacacuaccgaacuacuccggcgcucucacaccaaacaugggacucgccccgcccgucgcccccaccuuucccggcgaacaaauucucuucuuccgaucucacaucccccuaaaaggcggaguagcagacccagucaucgacugccucgucccacaagaauggauccaacaccuauaccaagaauccgcacccucccaaaccgacgucgcccuuauccguuuuacaaaccccgacaccggacgcguacuuuucgaagccaaacuacaucgcuccggcuacaucacagucgccaacaccgguucgcgccccaucgucguccccgccaauggauacuuccgcuucgauucgugggucaaccaguuuuacucccucgccccaguaggaacagguuaa

SEQ ID NO: 39367 - RNA, 1587 nt, Artificial Sequence
  derived and/or modified sequence opt11 from VP1__Norovirus_and/or_Norovirus-like__JN183161
augaugauggcauccaaggacgcccccuccaacauggacggcaccagcggcgcaggccagcucgucccagaaguaaacgccgccgaaccacuuccccucgaaccaguagucggagccgcaacagccgccgcaaccgcaggccaagugaaccucauagacccuuggauuaugaacaacuucguccaagcccccgaaggagaauuuaccaucucacccaacaacacccccggcgacauacucuucgaccuacaccucggcccccaccuuaaccccuuccuccaacaccucucccaaauguacaacggaugggucggaaacaugcgaguccgcgucaugcuagcuggcaacgccuucaccgccggaaaaauaaucaucugcugcgugccucccggauucgcaucacaaaacaucucuaucggccaagccaccauguucccccacgucauagcagaugugcggguccucgaacccauagaaauaccccuagacgacguacgaaacguccucuuccacaccaacgaaaaccgaccaaccaugcgacuccuaugcaugcucuacacaccccucagagcuggcggcgcaucuagcggcaccgacccauucguuaucgcaggccgcguacuuaccugcccagccccagacuucaacuuccuauuccucgucccaccauccgucgaacaaaagacccgacaacuaacagucccaaauaucccccucaacaacauggccaacucacgaguacccgcaaugauaaacaagaugacaguaagcuccgaccagaaccaggucguccaauuccaaaacggccgcuguacccuagaaggccaacuacucggaaccacacccgucuccgccucccaaguugcacgcauccgaggcaaagucuucucaaccgccucaggcaagggauuaaaucucacagaacucgacggcacucccuaccacgcauucgaaagccccgcaccacucggcuucccagacauaggcgccugcgacuggcacgucagcaccuucaaagucgaccaaaaccuauccggagacccaaugucccgucuagacauaaaacaaaacgcccccuucgcuccacaccucggcucaaucgaauuuacuagcgaccaagaucccacuggcgaccaauuaggaacccuagcaugggucucccccucuaccuccggcacucgaguugaccccuggaaaauccccagcuacggcuccacagucacggaauccacccaucuugccccacccauuuucccgcccggcuucggcgaagcaauaguauacuucauguccgacuuccccaucgucagcggcaauaccgcucaaguccccugcaccuuaccccaagaauuugucucccacuucguagaacaacaagcaccuauccgcggcgaagccgcccuacuucauuacguagacccugacacccaccggaaccucggcgaguucaaacuuuaccccgacggcuucaucacaugcguacccaacaccggcggcggaccccaaaaucucccuaccaacggcgucuucgucuucuccucguggguaagccguuauuaccaacucaaacccgucggaaccgccuaa

SEQ ID NO: 39368 - RNA, 1587 nt, Artificial Sequence
  derived and/or modified sequence opt11 from VP1__Norovirus_and/or_Norovirus-like__KT906670
augaaaauggccuccaacgacgccgcacccagcaacgacggcgccgccggccucguacccgaaggaaacaaugaaacccuuccccuggaacccgucgccggcgcugccaucgccgccccagucaccgggcaaaacaacaucaucgacccauggauacgaaccaacuucguccaagcccccaacggcgaauuuaccgucagcccccgaaacucccccggcgaaauccuacuuaaccucgaacuuggccccgaccucaaucccuaccucgcccaccucucccgaauguacaacggcuacgccggcggcgucgaaguccaaguacuacuugccggaaacgcauucaccgccggaaaaauccucuucgccgccgucccacccaacuucccuguagaguuccucagccccgcccaaaucaccauguuaccucaccucaucgucgacguccgaacccucgaacccaucaugaucccccuaccagacgucagaaacaccuucuuccacuacuccaaccaacccaacucgcgaaugcgcuuagucgccaugcucuacacaccccuccgcuccaacggcuccggcgacgacgucuucacaguaucaugccgcguccuaaccagaccaacaccagacuucgaguucaccuaccuaguaccacccucgguagaauccaaaaccaaacccuucucucucccuauacuaacucucuccgaacuuacaaacucccgauucccaguacccauugauucacucuucaccgcucaaaacaacguauuacaaguacaaugccaaaacggccgcugcacccuagauggagaacuccaaggcacaacucagcuccuccccucaggcaucugcgccuuccgaggccgcguaacagcacaaaucaaucaacgcgaccgcuggcacaugcaacuacaaaaccucaacggcaccaccuacgacccgaccgacgacguccccgcaccccucggcaccccagacuucaaaggcguagucuucgguaugguaucacaacguaacguaggcaacgaugcacccggcucaacacgcgcucaacaagcaugggucagcaccuacucaccccaauucguccccaaacucgguuccguaaaccuaagaaucuccgacaacgacgacuuccaauuccaacccaccaaauucaccccagucggaguuaacgacgacgacgacggccacccauuccgacaaugggaacuccccaauuacucuggcgaacuaacccuuaacaugaaccucgccccacccgucgcccccaacuuccccggcgaacaauuauuauucuuccgcagcuucguacccugcuccgguggcuacaaccaaggcaucaucgacugccucaucccacaagaauggauccaacacuucuaucaggaaucagcccccucccaaucagacguagcccugauccgcuaugucaaccccgauaccggccgaacccuauucgaagccaaacuacaccgcuccggauacaucaccgucgcacacuccggcgacuacccccuugucgucccagccaacggacacuuccgcuucgacucauggguaaaccaauucuacucacuagcauaa

SEQ ID NO: 39369 - RNA, 1587 nt, Artificial Sequence
  derived and/or modified sequence opt11 from VP1__Norovirus_and/or_Norovirus-like__KT906671
augaaaauggcuuccaacgacgcagcccccuccaacgacggagccgccggccuagucccagaagguaacaacgaaacacucccccucgaacccguugccggcgcagcaaucgccgcccccguaaccggccaaaacaacaucaucgacccauggauccgcaccaacuucguccaagccccaaauggagaauuuacaguuuccccacguaacuccccaggagaaauccuccucaaccucgaacucggucccgaccucaaccccuaccucgcacaccuuucacgaauguacaacgguuacgccggcggugucgaaguucaaguauuacucgccggcaacgcauucacagccggcaaaauccucuucgcagccguacccccaaacuuccccgucgaauuucuuuccccagcccaaaucaccaugcuuccccaccucaucgucgacguccgcacccuagaacccaucaugaucccccuccccgacguccgcaauaccuucuuccauuacuccaaccaacccaacucacgcaugcgauuaguagcaaugcuauacacaccccuccguucaaacggcuccggugacgacgucuucaccgucucaugccgaguccuaacccgccccacccccgacuucgaauuuaccuaccugguucccccauccgucgaaucuaaaaccaaaccuuucucccuucccauccucacccuauccgaacugaccaacucccgcuuccccgucccaauagacucccucuucaccgcccaaaacaacguccuucaaguccaaugccaaaauggcagaugcacccucgacggagaacuccaaggcacaacccaacuccugccaaccgguauaugcgccuuccgaggccgcguaacagcccaaauuaaccaacgcgacagauggcacaugcaacuccaaaaccucaacggcacaacuuacgaccccacagacgacguccccgcuccacucggcacacccgacuucaaaggcgucgucuucggcauggucucccaacgaaacguaggcaacgacgcacccggcuccacuagagcccaacaagccugggucuccacuuauucaccccaguucguacccaaacugggcuccgucaaccuccgcaucuccgacaacgacgacuuucaguuccagcccaccaaauuuaccccaguuggugucaacgacgacgacgacggacacccuuuccgccaaugggaauuaccaaacuacucuggcgaacuuacccucaacaugaaccuugccccgcccguggccccuaacuuccccggcgaacaacucuuauuuuuccgcuccuucguccccugcucagguggcuacaaccaaggcauaauugacugccugaucccucaagaauggauacaacacuucuaccaagaaagcgcccccucacaaucagacguggcccucauaagauacgucaaccccgacaccggucgcacacuuuucgaagccaaacuccaccgauccgguuacaucaccguagcacauagcggcgacuacccccuaguaguccccgccaacggucacuuccgauucgacucaugggucaaccaauucuacucccucgccuaa

SEQ ID NO: 39370 - RNA, 1587 nt, Artificial Sequence
  derived and/or modified sequence opt11 from VP1__Norovirus_and/or_Norovirus-like__AB810013
augaaaauggcaucaaacgacgcagcccccucaaacgacggcgcagccucucuugucccagaggccaucaacgaaaccaugccgcucgaacccgucgcaggagccuccaucgccgcccccguagccggccaaaccaacauuaucgaccccuggauaagaaccaacuuuguucaagcgcccaacggcgaauuuaccguaucaccacgaaacagccccggagaaauccuccuuaaccucgaacuaggccccgaccucaacccuuaccucgcccaccuauccagaauguacaacggauacgccggcggaguagaaguucaaguucuucuagcuggaaacgccuucaccgccggcaaaauccucuucgccgcaauacccccaaacuuccccguagacaugauauccccagcacaaaucacaaugcucccacaccuaaucgucgacguacguacccucgaacccaucaugauaccccucccugacguacgcaaugucuuuuaccacuucaauaaucaaccacaaccccgcaugcgccucgucgccaugcuauacacuccccuacgcucaaacggcucaggagacgacguauucaccgucuccugccgcguucuaacccgucccaccccggacuucgaguucauauaccuagucccacccuccgucgaaagcaaaaccaaacccuuuacccuccccauacucacaauauccgaacucacgaacucacgauuccccauacccaucgaacaacucuacacagcacccaacgaaaacaacgucguccaaugccaaaacggccgcuguacacuagacggagaacugcaaggcacgacccaacuacuaucguccgcagucugcucauaccgaggccgaaccguagcaaacagaggagacaacugggaccaaaaccuacuacaacucaccuacccaucaggugccuccuacgauccuaccgaugagguacccgcaccccucggaacccaagacuucuccggaauccuauacggaguccuuacucaagacaacgucuccgaagguacaggcgaagccaaaaacgccaaaggcgucuacaucuccacaaccagcggcaaauucacacccaaaauuggcuccauaggccuccauucaaucaccgaaaacguccacccaaaccaacaaucccgcuuuacccccgucggagucgcccaaaacgaaaacaccccauuccaacaauggguccucccacacuacgccggcgcacuggcccuaaauaccaacuuagcccccgccgucgcaccaaccuuccccggcgaacaacuccuauucuuccgaucccgcguacccuguguccaaggauuacgcggccaagacgccuucaucgacugccuccucccacaagaguggguaaaccauuuuuaccaagaagccgcccccucccaggccgacguagcucuuauacgcuacgucaaccccgacaccggccgcacacucuucgaagccaaacuccaccgaagcggauucauaaccgucucacacaccggugcauacccccucgucgucccacccaauggccacuuccgauucgacuccuggguuaaccaauucuacucauaa

SEQ ID NO: 39371 - RNA, 1584 nt, Artificial Sequence
  derived and/or modified sequence opt11 from VP1__Norovirus_and/or_Norovirus-like__EU096510
augaaaauggccuccaacgacgccaaccccuccgacggauccacagcaaaccucguacccgaagucaacaacgaaguuauggcucucgaacccgucgucggcgcagcuauagcagcccccgucgcaggacaacaaaacgucaucgaccccuggauccgcaauaauuucguccaagcccccggcggcgaauuuaccgucagcccccgcaacgcccccggcgaaauacuaugguccgcuccccucggacccgaccucaauccauaccucucccaccuagcccgaauguacaauggcuacgccggcggauucgaaguccaagucauccucgccgguaacgccuucaccgccggcaaaauaaucuucgccgccguaccaccaaacuucccuaccgaaggccucucccccucccaggugacaauguucccccauaucauagucgacguccgccagcuugaaccaguauuaaucccccuacccgacguccgaaacaauuucuaccacuacaaccaaagcaacgaucccacaaucaaacuaaucgcaaugcuauacacaccccuccgcgcaaauaacgccggagacgacgucuucaccgucuccugccgcguuuuaaccagaccauccccagacuucgacuucauauuccuagucccacccaccgucgaaucccgcaccaaaccauucacuguaccaauacugaccguagaagaaaugacuaacucccgcuuccccauuccccuggaaaaacuuuucaccggccccuccggagccuucguuguccaaccccagaacggccgauguaccaccgacggcguccuacuaggaaccacccaacuauccccagucaacauauguaccuuccgcggagacgucacccacaucgcaggcacccacaacuacaccaugaaccuggccagccaaaacuggaacaacuaugacccaacagaagaaaucccugccccacuaggaacccccgacuucguaggccgcauccaaggcaugcucacccagacaacacgcggcgacggcagcacccgcggccauaaggcuaccguuuccaccggcgacguacacuucacuccaaaacuaggauccauccaauucaacaccgacacaaacaacgacuucgaaacuggccaaaacaccaaauucacccccgucggcgucguccaagacggcaacggcacccaucaaaaugaaccacaacaguggguccuacccuccuacucuggccgcaccggccacaacgcccaccucgccccagcagucgccccuaccuuccccggagaacaacuccucuucuuccgcuccacaaugcccggcugcuccggcuaccccaacaugaaccuagacugccugcucccccaagaauggguccaacacuucuaccaagaagcugccccugcacagagcgacguugcacuccuccgauucgucaaucccgacaccggccgaguccucuucgaaugcaaacuccauaagucaggcuacgucacggucgcccacaccggacaacacgaccuaguaaucccacccaauggauacuucagauucgacucauggguaaaccaauucuacacacucuaa

SEQ ID NO: 39372 - RNA, 1584 nt, Artificial Sequence
  derived and/or modified sequence opt11 from VP1__Norovirus_and/or_Norovirus-like__EU096513
augaaaauggccucuaacgacgcaaauccgucagacggcucagccgcaaaccucgucccagaagucaacaacgagguaauggcacuugaacccgucgucggagccgccaucgccgcacccguagccggccaacaaaacgucaucgaccccuggauccgcaacaacuuuguccaagcacccggcggcgaauuuaccguauccccacgcaacgcccccggcgaaauccuaugguccgcaccccuaggccccgaccuuaaucccuaccuaucccaccucgcccgaauguacaacggcuacgccggcgguuucgaaguccaagucauccucgccggcaacgccuucacagcaggaaaaaucaucuucgcagccguacccccaaacuuccccacugaaggacucuccccuucccaagucacaauguucccccacaucaucguagauguccgucaacuugaacccguucuaaucccacuccccgacguccgcaacaacuucuaccacuacaaccaaagcaacgacuccaccaucaaacugaucgcaaugcucuacacaccccuacgugcaaacaacgccggcgaagacgucuucaccguaagcugccgaguccuaacccgcccauccccagacuuugacuucauauuccuaguaccacccacaguugaaucacgcacaaaacccuucaccgucccaauccuaaccguagaagagaugacaaacucacgcuuccccaucccccuugaaaaacucuucaccggccccuccggcgccuucgucguccaaccccaaaacggccgcugcaccaccgauggcguacuacuaggaaccacccaacuuucccccguaaacaucugcaccuuucgcggagacgucacccacauugcgggaucucgcaauuacaccaugaaucucgccucccucaacuggaacaauuacgacccaacagaagaaauaccugcaccccuaggcacacccgacuucguaggcaaaauccagggcguacucacacaaacaaccaaaggugacggcuccacccgaggucacaaggccaccgucuacaccggcuccgcccccuucacccccaaacuaggaucaguccaauucucaaccgacacagaaaaugacuucgaagcacaccaaaacacuaaauucacgcccguaggcgucauccaagacggcuccacaacacaccgcaacgaaccacaacaauggguccuccccagcuacagcggacguaacguccacaacguacaucucgcacccgccgucgcaccaaccuuccccggcgaacaacuacucuucuuccgcucuacaaugccaggauguuccggcuaccccaacauggaccuagacugccuccucccacaagaauggguccaacacuucuaccaagaagccgcucccgcccaauccgacguagcccuccuccgauucgucaaccccgauaccggccgcguucucuucgaaugcaaacuacacaaaucuggcuacguaacuguagcccacaccgggcaacacgaccuagucauucccccaaacggcuacuuccgauuugacuccuggguaaaucaauucuacacccuauaa

SEQ ID NO: 39373 - RNA, 1584 nt, Artificial Sequence
  derived and/or modified sequence opt11 from VP1__Norovirus_and/or_Norovirus-like__EU096514
augaaaauggcaucaaacgacgccaacccauccgacggcuccgccgccaaccuugucccagaagucaacaacgaggucauggcccuagagcccgucgucggcgcagccaucgcagcccccgucgcaggacaacaaaacgucaucgaccccuggauccgaaacaacuucguccaagccccgggcggagaguucaccguaucccccagaaacgccccaggcgaaauccucuggagcgcaccacuaggccccgaccucaaucccuaccuaucccaccucgccagaauguacaacggguacgccgguggauucgaaguccaaguaauccucgcaggcaacgccuucaccgccggcaaaaucaucuucgcagccguacccccaaacuucccaaccgaaggacucuccccaucccaagucacaauguucccccacaucauaguagacguccgccaacuagaacccguccuaauaccucuccccgauguccgaaacaacuucuaccacuacaaccaaucuaacgacuccacaaucaaacucaucgccaugcucuacacaccccuacgcgccaacaacgccggugaagacguauucaccguuagcugccgcguacucacccgcccaucccccgacuucgacuucaucuuccucguucccccaaccgucgaaucccgaaccaaaccauucaccguccccauucucaccgucgaagaaaugacaaacucucgcuuccccaucccccucgaaaaacucuuuacaggacccuccggugccuucgucguucaaccccaaaacggccgcugcaccaccgacggaguccuacuaggaacaacccagcuaagcccaguaaacaucugcaccuuucgaggcgacgucacacacaucgccggaucacgaaacuauacaaugaaccucgccucacucaacuggaacaacuacgacccaacagaagagauccccgcaccccucggaacucccgacuuuguuggcaaaauccaagguguauuaacccaaaccacaaaaggcgacggauccacucgcggccacaaagccacagucuacaccggcuccgcacccuucaccccaaaacucggauccguccaauucucuaccgacaccgaaaacgacuucgaaacccaccaaaacaccaaauucacaccaguaggcguaauccaagauggcggaaccacacacagaaacgaaccacaacaauggguccuccccuccuacuccggccgaaacguacacaacguucaccuugccccagccgucgcccccacauucccaggcgaacaacuccuauucuuccgauccaccaugccugggugcucaggcuaccccaacauggaccuagacugccuauuaccccaagaauggguccaacacuucuaccaagaagccgcacccgcccaaucagacgucgcccuccuacgauucgucaaccccgacacaggccgaguccuuuucgaaugcaagcuccacaaauccggcuacguaaccguagcccacaccggccaacacgaccuagugauucccccgaauggauacuuucgcuucgacagcugggucaaccaauucuacacccuguaa

SEQ ID NO: 39374 - RNA, 1584 nt, Artificial Sequence
  derived and/or modified sequence opt11 from VP1__Norovirus_and/or_Norovirus-like__EU096512
augaaaauggcaucuaacgacgcgaaccccuccgacggaucagccgccaaccuaguaccagaagucaacaacgaagugauggcacucgaacccgucgucggagccgcaaucgccgcccccguagcaggccaacaaaacgucaucgaccccuggauccgcaacaacuucguacaagcccccggcggagaguucaccgucagcccucgcaacgcccccggagaaauccucugguccgcgccucuaggacccgaccuaaaucccuaccucucgcaccuagcccgcauguacaacggcuacgcaggcggcuucgaaguccaagucauccuugccgguaacgccuucacagccggaaaaaucauuuucgccgccgucccacccaacuuuccaaccgaaggccuuucuccaucccaaguaacuauguucccacacauaaucgucgacguccgacaacucgaacccguacuaaucccacuaccugacguucgcaacaacuucuaccauuacaaccaaucgaacgacagcacaauuaaacucaucgcaaugcucuacacaccccuccgugccaacaacgccggcgaagacguuuucaccguguccugccgcguccucacccgccccagcccugacuucgauuucaucuuccuaguacccccuaccgucgaaucccgaaccaaaccauuuacaguccccauucugaccgucgaagagaugaccaacucccgcuuccccauaccccucgaaaaacuuuucacaggccccucaggcgcuuucguaguccaaccccaaaacggccgcugcaccacagacggcguacuacucggcaccacccaauuaucaccagucaacaucugcacauuccgcggcgacgucacucacauagcaggcucaagaaacuauacaaugaaccuugcaucacuaaacuggaacaacuacgauccaacagaagaaauacccgccccacucggcacacccgacuucguaggcaaaauccaaggcguacuaacacaaacaacuaaaggcgacggauccacccgcggacacaaagccaccgucuacaccggcagugcuccauucacccccaaacuuggcucuguucaauucuccaccgacaccgaaaacgacuucgaaacccaccaaaauaccaaauuuacuccggucggcgucauccaagacggcuccacgacccaucgaaacgaaccccaacaauggguucuccccucauacuccggacgcaacguucacaauguucaccuagccccugcagucgcccccacauuccccggcgaacagcuccuauucuuccgcucaaccaugccgggcugcuccggauacccaaacauggaccuugacugccuccucccccaagaauggguacaacacuucuaccaagaggccgccccugcccaaagcgacguugcccuccuccgauuuguuaacccagacaccggacgcguacucuucgaaugcaagcuccacaaaucaggcuacguaaccgucgcgcacaccggccaacacgaccucguaaucccacccaacggauacuuccgcuucgacucaugggucaaccaauuuuauacucuauag

SEQ ID NO: 39375 - RNA, 1581 nt, Artificial Sequence
  derived and/or modified sequence opt11 from VP1__Norovirus_and/or_Norovirus-like__KU311161
augaugauggcaucuaaagacgcacccuccaacauggacggcaccucaggagcaggucaacucguccccgaaguaaaugccgcagaaccucugccucucgaaccagucgucggcgcagccaccgccgcagcaaccgccggccaagucaacaugaucgaccccuggaucaugaacaauuucguacaagcaccagaaggagaauuuacaaucucaccaaacaacacccccggcgacauccucuucgaccuacgccucggcccacaccuaaauccauuccuccuccaccucucccaaauguacaacggcuggguuggaaacaugcgcguacgaguaaugcuagccggcaacgcauucuccgcagguaagaucauaaucugcugcguaccacccggcuucgaaucccaaaacaucuccaucggacaagcaacuauguucccccaugucaucgcagacguacgcguccucgaaccaaucgaagucccccuagacgacguacgaaacguacuuuuccacaccaaugagaaccgcccgacaaugcgccuccuaugcaugcucuacacaccccucagagccggcggcgcaagcuccggcaccgaccccuucgucauagccggacgcguacuaaccugccccgcccccgacuucaacuuucucuuccucguaccacccuccguugaacagaaaacacgucaacucaccauccccaacaucccccuaaacaaccucgcaaacucacgcguacccgccaugaucaacaaaaugaccguauccgccgaccaaaaccaagucguacaauuccaaaacggccguugcacacuugaaggacaacugcucggcaccacgcccguaucagccaaccaagucgcccgcauaagaggaaaggucuucuccaccaacagcggaaccggacucaaccuuacagaaguagacggaacgcccuaccacgcuuucgaaucacccgcaccccucggcuucccugacaucggaaacugcgacuggcacgucuacgccuucaagguuaaucaaaacaccggugaccccauguaccgccucgacauaacccaagguaacuccuucgcaccccaccucggcaguaucgaguucucuuccgaaaaccacccuuccggcgaccaacucggcacccuuaccuggauauccccacucaauaacgcaucucgcgucgaccccuggaaaauccccaccuacggauccacccucacagaauccacaaaccucgccccucccauauucccacccggcuucggcgaauccauagucuacuucauguccgacuuccccaucgucuccggcaacaccgcccaaauccccugcacucuuccccaagaguucguauccucauucgucgaacaacaagcccccauccgaggugaagcagcacuccuccacuacgucgaccccgacacucaccgcaaccucggcgaguucaaacuauacccagacggcuucaucacgugcgucccaaacaccggcggcggaccucaaaaccucccauccaacggagucuucgucuucucauccugggucucccgauacuaccaacucaaacccgucggcaccuaa

SEQ ID NO: 39376 - RNA, 1581 nt, Artificial Sequence
  derived and/or modified sequence opt11 from VP1__Norovirus_and/or_Norovirus-like__KX907730
augaugauggccuccaaagacgccccgagcaacauggacgguacaagcggcgccggccaauuaguaccugaagucaacgccgccgaaccuuuaccccuugaacccguugucggcgcagcaacagccgucgccacagccggccaagucaacaugaucgacccuuggaucaugaacaacuucguccaggcaccagaaggcgaguucacaauaagccccaacaacacaccaggugacauacucuucgaccuccgccucggcccacaccucaaccccuuccuccugcaccucucacaaauguacaacggcugggucggcaacaugagaguccgagucaugcucgccgggaacgcauucucagccggcaaaaucaucauaugcugcgucccacccggauucgaaucccaaaacaucuccauaggccaagccaccauguucccacacgucauugccgacguccgcguccuagaaccaauagaagucccacuagacgacgucagaaacguacuauuccacaccaacgaaaaccgacccacaaugcgccuccuuuguaugcuuuacaccccacuccgagccggcggagcuagcucaggaacagaccccuucgucaucgcaggccgcguccuaaccugccccgccccagacuucaacuuccuauucuuaguacccccaucagucgaacagaaaacccgccaacuaacaauccccaacauaccccucaacaaccucgcuaacucucgcgucccagccaugaucaacaaaaugaccgucucagccgaccaaaaccaagucguccaauuccaaaacggccgcugcacccucgaaggucaacuacucgggaccaccccugucagcgccaaccaagucgcccggauuagaggcaaagucuucuccaccaacuccggcacaggacucaaucucacagaagucgacggcacccccuaccacgccuucgaaucccccgcaccccuaggcuucccagacaucggcaacugcgacuggcacgucuaugccuucaaggucaaccaaaacaccggcgacccaauguaccgccuagauaucacccaaggcaacuccuucgccccacaccucggcuccaucgaauuuuccuccgaaaaccaucccuccggagaccaacuaggaacacucacuuggauuucaccccuaaacaacgccuccagagucgaccccuggaaaaucccaaccuacggcuccacacucaccgaaucaaccaaucucgccccucccaucuucccacccggcuucggcgaagccauaguuuacuucaugagcgacuuccccauaguauccggaaacaccgcccaaauccccugcacgcuaccccaagaauuugucuccucauucgucgaacaacaagcgccuauccgcggcgaagccgcccuccuccacuacgucgacccagacacccaccgcaaccuuggcgaguucaaauuauaccccgacggauucauaaccugcguccccaacaccggaggcggcccacaaaaccuaccguccaacggagucuucguauucagcuccuggguaucccgcuacuaccaacucaaacccguagguacauga

SEQ ID NO: 39377 - RNA, 1581 nt, Artificial Sequence
  derived and/or modified sequence opt11 from VP1__Norovirus_and/or_Norovirus-like__EU096507
augaaaauggcauccaaugacgccaaccccucagacgguuccacagccaaucuagucccagaagucaacaacgaagucauggcacuagagcccguagucggagcagccaucgccgccccagucgccggccaacagaaugucaucgaccccuggauccgaaacaacuucguacaagcccccgguggcgaauuuaccguaucuccacgaaacgcaccaggugaaauccuauggagcgcaccccuaggacccgaccuaaaccccuaccucucccaccucgcccgaauguacaacggauacgccggcgguuuugaaguccaagucauccuagccggaaacgcguuuaccgcaggaaaaauaauauucgcagccgucccacccaacuucccaaccgagggccuuucacccucccaaguaaccauguucccccacauaaucgucgacguccgccaacucgaaccuguacucaucccacucccagacguccgcaacaauuucuaccacuacaaucaaagcaacgacagcaccaucaaacucaucgccauguuauacacaccccuacgggccaacaacgccggcgacgacguauucacaguaucaugccgaguauuaacccgaccaucacccgacuucgacuucaucuuccucguaccacccacugucgaaucacgaacaaaacccuucacgguccccauucuuacagucgaagaaauguccaacucccgauuccccgucccccuagaaaaacuguacacaggccccagcucugccuucgucguacaaccccaaaacggacguugcaccaccgacggcguccuacucggcaccacccagcuauccgcagucaacaucugcaccuuccgaggcgacgucacccacauagccgguucccacgacuacacuaugaaccuagcaucccaaaacuggaacaacuacgaccccaccgaagaaauccccgcaccccucggcacgcccgacuucguuggaaaaauccagggcguacuaacucaaacuacacgagaagacggcuccacccgcgcccacaaagcaacagucuccacaggauccguacacuucaccccaaaacuaggcuccguccaauacacaacagacacgaacaacgacuuccaaacaggccaaaacaccaaauucaccccuguaggugucauucaagacggcuccaaccaccaaaacgaaccccaacaauggguacuacccaacuacuccggccgcacaggacauaacguccaccuugcucccgccgucgcaccaaccuuccccggggaacaacuccuauuuuuccgcagcaccaugccgggauguuccgguuacccaaacaugaaccucgacugccuccucccccaagaauggguccaacacuucuaccaagaagcagcaccagcccaauccgacguagcacuccuccgauucgucaaccccgacaccggcagaguauuauucgagugcaaacuacacaaauccggcuacgucaccguugcccacaccggcccccacgaucucgucaucccacccaacgguuacuuccgcuucgacuccugggucaaucaguucuacacccuauga

SEQ ID NO: 39378 - RNA, 1581 nt, Artificial Sequence
  derived and/or modified sequence opt11 from VP1__Norovirus_and/or_Norovirus-like__AB810007
augaaaauggccuccaacgacgccgcccccuccaacgacggcgccgccucccucguaccagaagccauuaacgaaaccaugccccuagaacccguugccggcgcauccaucgcagcccccguugcaggccaaacuaacaucaucgaccccuggauccgcaccaauuucguccaagccccaaacggcgaauuuaccgucagcccccgaaacucccccggagaaauacugcucaaucucgaacucggucccgaccuuaaccccuaccuagcacacuuaucacgcauguacaacggcuacgcaggcggcguagaaguccaaguacuucuugcaggcaacgccuucaccgccggcaaaauccucuucgcagccaucccucccaacuuccccgucgacaugaucucacccgcccagaucacaaugcuaccacaccucaucguugacguccgcacacuggaacccaucaugauuccacuaccagacguacguaacgucuucuaccacuucaacaaccaaccccaaccccgcaugcggcuagucgcaaugcuauacacaccacuccgauccaacggcucaggcgacgacgucuuuacagucucaugccgaguccucacgcgaccaacaccugacuucgaguucauauaccucgucccucccuccgucgaauccaaaaccaaaccuuucacccuccccauccuuaccauauccgaacuaacaaacucccguuucccaauccccaucgaacaacucuacaccgcccccaacgaaaacaacguuguccaaugccaaaacggccgcugcacucuugacggcgaacuccagggcacaacucaacuccucuccuccgccgucugcucguaucgcggccgcaccguagcaaaccgcggagacaacugggaccaaaaccuccuccaacuaaccuaucccucaggcgccuccuacgacccuacagaugaaguucccgccccacucggaacccaagacuuuucaggcauacuuuaugguguccucacccaagacaacguauccgaagggaccggagaagcuaaaaacgccaaagguguauacaucuccacaacuucuggcaaauucaccccaaaaaucggcucaaucggacuccacuccaucacagaaaacguccauccaaaccagcaaucucgauucacccccgucggcguggcacaaaacgaaaacacacccuuccaacaauggguauuaccccacuacgccggagcccuagcacucaauacaaaccucgccccagcagucgccccaaccuuccccggcgaacaacuacucuucuuccgaucccgcgugcccugcguacaaggccuccgcggccaggacgccuucaucgacugccuccuuccccaagaauggguaaaccacuucuaccaagaagccgcaccuagccaagccgacguagcacucauacguuacgucaaccccgacaccggccgaacccucuucgaagccaaacuacaccgaucaggcuucaucaccgucucccacaccggagcauacccucucgucgucccacccaacggccacuuccgauucgacucuugggugaaucaauucuaa

SEQ ID NO: 39379 - RNA, 1581 nt, Artificial Sequence
  derived and/or modified sequence opt11 from VP1__Norovirus_and/or_Norovirus-like__AB809989
augaaaauggcuucuaacgacgccgcacccagcaacgacggcgcugcuucccuagucccagaagcaaucaacgaaaccaugccccucgaacccguagcgggcgccucaauagcugcccccguagccggccagaccaacaucaucgaccccuggauccgcacaaacuucguccaagcccccaacggugaauuuaccgucagcccacgaaauagcccaggcgaaauacucuuaaaccucgaacuuggaccagaucuaaaccccuaccucgcccaccucucacgaauguacaacgguuacgcgggaggcguagaaguccaaguccuccucgccggcaaugcuuucacugcaggcaaaauccuauucgccgcaauaccacccaauuuccccgucgacaugaucagccccgcacaaaucacaaugcuaccucaccuaaucgucgacguccgcacauuagaacccauaaugauaccacucccagacguccgaaacgucuucuaccacuucaacaaccaaccacaaccccgcaugagacucguagccaugcuauacacaccccuccgcucaaacggcuccggcgacgaugucuucaccgucuccugccgaguacucacccgcccaacccccgacuucgaauuuaucuaccucguuccacccucugucgaauccaaaaccaaacccuucacccuaccuauacucaccaucucagaacucaccaacucacguuuccccaucccaaucgaacaacucuacaccgcucccaacgaaaauaacguaguccaaugccaaaacggacgaugcacccuagacggcgaacuccaaggaaccacccaacuccucuccucagccgucugcuccuacagaggccgcaccgucgccaacuccggcgacaacugggaccaaaaucuucuacaauuaacauauccaucuggcgcauccuacgacccuaccgacgaaguccccgcaccccucggcacccaagauuucucaggcauccucuacggcgugcuaacccaagacaacgucucugaaggcaccggugaagccaaaaacgccaaaggcgucuacaucucaaccacauccggcaaguucacccccaagaucggaucaaucggccuacacuccaucacagaaaauguccaccccaaccaacaaucacgauucacuccagucggugucgcccaaaacgaaaacaccccauuccaacaauggguccuaccccacuacgccggagcccucgcccucaacacaaaccucgccccugcagucgcccccaccuuccccggcgaacaacuacucuucuuccgaucucgaguacccuguguucaaggacuccgcggacaagacgcauucauagauugccuccucccccaagaauggguaaaccacuucuaccaagaagccgcccccucucaagccgacguagcgcuaauacgcuacgucaacccugacacuggccggacccucuucgaagcaaaacuccaccgaucaggcuucauuaccgucucacacacaggcgccuacccacucguagucccucccaacggccacuuccgauucgacagcuggguaaaccaguucuaa

SEQ ID NO: 39380 - RNA, 1581 nt, Artificial Sequence
  derived and/or modified sequence opt11 from VP1__Norovirus_and/or_Norovirus-like__AB810000
augaaaauggcaucaaacgacgcagcacccucuaaugacggagccgccucccucguaccagaagccaucaacgaaacuaugccccuugaacccgucgccggugccucuaucgcagccccagucgccggccaaacaaacaucaucgacccauggauacgaacaaacuucguccaagcuccaaacggcgaguucacggucucaccccguaacucaccuggagaaauccuccucaaccuagaauuaggccccgaccucaacccuuaccuagcccaccuaucccgaauguacaacggauacgcaggaggcgucgaaguccaaguccuccuagccggaaacgccuuuacagccggcaaaauccucuucgccgccauaccacccaacuuccccgucgacaugaucagccccgcucaaauaaccaugcuuccccaccucaucgucgacguccgcacccuagaacccaucaugaucccccuacccgacguacgcaacgucuucuaccacuucaacaaccaaccccaaccccgcaugcgacucguugccaugcucuacacaccccuccgcuccaacggcuccggagaugacguauucacaguauccugccguguccucacacgacccaccccagacuucgaguucauauaccucgucccucccucuguagaauccaaaacaaaacccuucacccuccccauccucaccaucucagaacucaccaacucccgcuuccccauacccaucgaacaacuauacaccgcccccaacgaaaacaauguaguccagugccaaaauggacgcugcacacucgacggcgaacuucagggcaccacccaacuacuauccucagcaguuugcucauaccggggccgcacagucgccaacuccggcgacaacugggaccaaaaccuccuccaacucacauaccccagcggagccucauacgaucccaccgacgaaguccccgcuccacuaggcacccaagacuuuuccggcauccuauacggcguccuuacccaagacaacgucuccgagggcacaggcgaagccaaaaacgccaaagguguauacauauccaccacauccggaaaauucacacccaaaaucggcucaauaggccuccacagcauaaccgaaaacguccaccccaaccaacagucccgcuucacccccgucggcguagcccaaaacgaaaacacaccauuccaacaauggguacuaccucacuacgccggugcacucgcauuaaacacaaacuuagcacccgcuguagcccccaccuuccccggcgaacaacuccuguucuuccgcucacgcguccccugcguccaaggccuccgcggacaagacgcauucaucgacugcuuacuaccccaagaaugggucaaucacuucuaccaagaagcagccccaucucaagcagacgucgcucuaauccgcuacguuaaccccgacaccggacgcacccucuucgaagccaaacuccaccgaucuggcuucaucaccgucucacacacaggagucuacccccuugucguaccaccaaacggccacuuccgcuucgacuccuggguaaaccaauuuuaa

SEQ ID NO: 39381 - RNA, 1575 nt, Artificial Sequence
  derived and/or modified sequence opt11 from VP1__Norovirus_and/or_Norovirus-like__AB809999
augaaaauggcauccaacgacgccgcccccuccaacgacggagccgccucccucguccccgaagcaauaaacgaaaccaugccccucgaacccgucgcaggcgccucaauagccgcuccagucgccggccaaacaaauaucauugacccuuggauccgcaccaacuucguacaagcaccaaacggagaguucacagucuccccaagaaacucccccggggaaauucuccucaaccuagaacuaggacccgaccucaaccccuaccucgcccaccucucccgcauguauaacggguacgccggcggcguugaaguacaaguccuacucgccggaaaugccuucaccgccgguaaaauacuauucgcagccaucccacccaacuuccccguugacaugaucucccccgcgcaaaucaccaugcuaccccaccuuaucgucgacgucagaacccucgaacccauaaugauaccccuacccgacguucgaaauguuuucuaccacuucaauaaccaaccccaaccccgaaugcgccucgucgcuaugcucuacacgccacuacgcuccaacggauccggcgaugacguuuucacaguuuccugccgcguccuaacacgaccgacccccgacuucgaguucaucuaccuagucccacccuccguagaauccaaaacuaaauccuucacccuccccauccucaccauaucagaacucaccaacagccgauuccccacccccauagaacagcucuacacagcccccaacgaaaacaacgucguccaaugccaaaacggacgaugcacucucgacggagaacuccagggcaccacccaacuccuaucuuccgcagucugcucauaccgcggccgcacaguagccaacuccggcgacaacugggaccaaaaccuguuacaacuaaccuaccccucaggcgccucauacgaccccacagacgaaguaccagcgccccucggcacccaagacuucuccgguauccucuacggcggacucacacaagacaacgucucagaaggaaccggcgaagccaaaaacgcaaaaggcgucuauauaucaaccacauccggaaaauucaccccaaaaaucggcaguaucggacuccacuccaucacagaaaacguccauccgaaccaacaaucccgcuucacccccguaggcgucgcccagaacgaaaacacccccuuccaacaauggguccuaccacacuacgcaggagcccucgcccucaacacgaaccucgcucccgccgucgcccccacauuccccggcgaacaacuccucuucuuccgcucccgcguuccaugcguccaaggacuacguggccaagaugccuucaucgauugccuucucccccaagaaugggucaaccauuucuaccaagaagccgcccccucacaagcagacgucgcacuaauccgguacgucaacccugacaccggccgaacacucuucgaagccaaacuacaccgauccggcuucaucaccguaagccacaccggcgccuacccguuagucguaccacccaacggccacuuccgauucgacucgugggucaacuaa

SEQ ID NO: 39382 - RNA, 1572 nt, Artificial Sequence
  derived and/or modified sequence opt11 from VP1__Norovirus_and/or_Norovirus-like__FJ692501
augaugauggcaucauccgacgcaaccccacccucugaaggagcuaccaaccuaguccccgaagucaacacccaagucguaccccuagaaccagucgccggagcugcggcagccgcccccuucaccggccagaacaacgucaucgaccccuggauauuccaaaacuucguccaagcaccccagggcgaguucacaguuuccccacgcaacaccccaggcgaaaucuuacuccgcaucccacuaggccccaaccuaaaccccuuucuugcccaccucuccagaauguacaacgcuuggguagguggaauggaagcagaaaugauccuggccggcaacgccuucaccgccgguaaacuccucaucgucgcccucccacccggcuucgaagccacccaacucacccccgcacaagcaaccgcauucccccacguuaucgccgacguacgaacucucgaaccuauccccaucccccucccugacauccgcaauguacuuuuccacuacaacggagaccccacccccaccauccaaaucguagucaugcuauauacgccccuacgcaccaacggcaacggcgaugacguauucacagucuccggacgccucuuaacgcgcccagcccccgacuucucauucuccuuccuagugccacccaccgucgaacagaaaacccgacccuucacccuccccaaccucgccguaagcgaccucuccaacagccgcuuccccgcaccaguaaacauccuacgcgcagacccuaacacaacccucgcccuagacuaccaaaacggccgcugcacccuagacggcgcucuacaaggaaccaccccaaccaacuccagcuuccugggcuaccugcgaggcaccguugaccgagucaacuccgaccaaguccacguccaccuucgcgaaccaaacggcgaccccuuccaacucggacuacccgggccacaaggcguccccgacuaucgagcaacucucgauaucuacgucgacugggaaaacaaaaaccacggcaaccccugcgaaggaacccucaacaccggaagccaaaccgaauauacaccaggccuaggcacccucaccuucaacaaaaccuccggcgacacccccgaacaaggcgaccccgucauaaugcgccucguagcuuuccgcucaaacuuaaccgaccaacucccagccuacaacggcgccuuuggccaaggcgaaaaucuagcaccucccgucuccccacccguacccggcgaagucuuccuccaauucggaagccgauacacccgccuaggcgaacgagagcucgccguccaaugccuccuccccucagaauggauaacccacuucuacucggaagccgcccccauccaaggcgaagcaaugcuucuccguuauguccaaccagaccuaggacgcauucuauucgaagcaaaacuauacaaggaaggcuucguaaccgucgccggugguaccaacccaguaaccuucccaauagacggcaccuucguagcagucucaugggucucccgaaacuucguacucucccccaugggcuccggucaaggacgacgccgcuaa

SEQ ID NO: 39383 - RNA, 1572 nt, Artificial Sequence
  derived and/or modified sequence opt11 from VP1__Norovirus_and/or_Norovirus-like__FJ692500
augaugauggcaucauccgacgccaccccacccuccgaaggcgccacaaaucuaguccccgaagucaacacccaggucguuccccucgaacccguagccggcgccgcagccgccgcacccuucaccggacagaacaacgucauagaccccuggaucuuccaaaauuuuguacaggccccucaaggcgaguucaccgucucaccgcgcaacacucccggcgaaauccuccuccgaauaccccuagguccaaaucucaaccccuuccuugcccaccuaucaagaauguacaacgccugggucggcggcauggaagcagaaaugauucucgcaggaaacgccuuuaccgccggcaaacuccuaaucgucgcccuacccccgggcuucgaagcaacacaacucacccccgcccaagccacagccuucccccacguaaucgccgacguccgaacacucgaaccaauucccaucccccucccagacaucaggaacguccucuuccacuauaacggcgauccaacucccacaauacagauagucguuaugcucuacacgccccuccgaaccaacggaaacggagacgacgucuucaccguauccggcagacuccucacccgacccgcacccgacuucuccuucucuuuucucguaccacccaccgucgaacagaaaacccgcucuuucacacugccuaaccucgcaguaucagaccucucaaacagccgcuuccccgcacccgucaacauccuccgcgccgaccccaacaccacacuagcucuggacuaccaaaacggccgcugcacucuagacggggcacuccaaggcaccacccccacuaacagcucauuccucggcuaccuucgcggcaccgucgaccgaguaaacuccgaucaaguacacguccacuuacgagaacccaacggcgaccccuuucaacucggccuucccggcccccaaggcguacccgacuaccgcgcuacgcuugacaucuacgucgauugggaaaacaaaaaccacggaaaccccugcgaaggcacccucaacaccggaucgcaaaccgaauacacacccggccuuggcacccucacauucaacaaaacaucaggagacacacccgaacaaggcgacccagucaucaugcgacucgucgccuuccgcuccaaccucaccgaccaacuccccgcauacaacggcgcauuuggacaaggagaaaaccucgcucccccaguauccccaccagucccaggcgaagucuuccuacaauucggcucacgcuacacccgccucggcgaacgcgaacuagccguccaaugccuccuccccagcgaauggaucacccacuucuacuccgaagccgcccccauccaaggcgaagccaugcuacuccguuacguccaacccgaccuuggacgaauacucuucgaagccaaacuuuacaaggagggcuuugucaccgucgcaggcggaaccaaccccgucaccuucccaaucgacggcaccuucgucgcagucucauggguaucccgaaacuucguccuuucacccaugggguccggccaagggagacgacgcuaa

SEQ ID NO: 39384 - RNA, 1572 nt, Artificial Sequence
  derived and/or modified sequence opt11 from VP1__Norovirus_and/or_Norovirus-like__AB031013
augaugauggcaucaaaagacgcaaccuccagcgucgauggcgccuccggcgccggccaacucgucccugaaguuaacgcgucagacccccuagcaauggaucccgucgcaggcuccagcaccgccgucgccaccgcaggacaaguaaaccccauugaccccuggaucauuaacaacuucguacaagcaccccaaggagaguucacaaucuccccaaauaacacccccggcggcguccuauucgaccuaucccucggcccacauuuaaaccccuuccuccuacaccucucccaaauguacaacgguuggguaggcaacaugcguguccguaucaugcucgcuggcaacgcauucaccgccggcaagauaaucgucuccugcaucccacccggcuucggaucacacaaccucaccaucgcccaggccacccuauucccccacgucaucgcagacguacgcacccuagaucccaucgaagucccacucgaagacguacgcaacguccuauuccacaacaacgaucgcaaccaacaaaccaugcgccucguuugcaugcuauacacuccccuacgaaccggaggaggcacaggcgacuccuucgucguagcaggccgcguaaugacaugcccuaguccagacuucaauuuccuauuccucguuccacccaccgucgagcagaaaacacgccccuucacccuccccaaccuuccccugucaucccucucaaacuccagagcaccccuccccaucucuggcaugggcauaucacccgacaacguccaauccguccaauuccaaaacgguagaugcacacucgacggucgccucgucggcaccaccccagugucacugucucacguagccaaaauacgcggcaccuccaacggaaccgucauuaaccuaaccgaacucgacggaaccccuuuccacccauucgaaggccccgcccccaucggauuccccgaucuuggcggcugcgacuggcacauaaacaugacacaauucggacacuccucccaaacccaauacgacguagacacgacccccgacaccuucguaccucaccucggaucaauccaagccaacggaauaggcuccggaaauuacaucggcguccuauccugggucuccccacccucccaccccuccgggucucaaguagaccucuggaaaauccccaacuacggcuccucaaucacugaagccacccaccucgcacccucagucuacccucccggcuucggcgaaguucuaguauucuucaugucaaagauccccggccccggagcauacucacuccccugccuccucccccaagaauacaucucccaccuagccuccgaacaagcacccacaguaggcgaagccgcccuacuacacuacguagacccagacaccggacggacccucggagaauuuaaagccuaccccgauggcuuccuaacaugcguacccaacggagcaucaucaggcccacaacaacuccccauuaacggcguuuucgucuucguauccugggucucccgguucuaccaacucaaaccugucggcaccgcaucuucagcacgauaa

SEQ ID NO: 39385 - RNA, 1572 nt, Artificial Sequence
  derived and/or modified sequence opt11 from VP1__Norovirus_and/or_Norovirus-like__KU253442
augaugauggccagcaaagacgccaccucauccgucgauggcgcaucaggcgccggccaacucguaccagaagucaacgcuucagacccgcucgccauggauccuguagccggguccuccaccgcagucgcaacagccggacaagucaaucccauagacccauggaucauaaacaacuucguccaggccccacaaggcgaauucaccauaucacccaacaacacaccaggcgacguccucuucgacuuaucgcuaggaccccacuuaaaucccuuccuccuccaccucagucaaauguacaacgguuggguaggcaacaugcgaguccgcaucaugcuagccgguaacgcuuucaccgcuggcaaaaucaucgucuccugcaucccccccggcuucgguucacauaaccucacaauagcucaagccacccucuucccccacgucaucgcagacguucguacccuagaccccaucgaagucccccuugaagacguccgcaacguacucuuccacaacaacgauaggaaccaacaaacaaugcgcuuagucugcaugcucuacacuccucuucgcacuggcggcggcaccggcgauuccuccgucguggcaggccgcgucaugaccugcccgucccccgacuucaacuuccucuuccucguuccaccuaccguggaacaaaaaacacgccccuucacucuaccaaaccuaccccuauccucucucucaaacucacgcgcaccccuaccaauuucaucgauggguaucucccccgacaacguccaauccguccaacuacaaaacggccgcugcacacucgacggccgccuggucggaaccaccccagucucccucucacaugucgccaaaauccgcggaaccucuaacggcaccgcuauaaaccuaaccgaacuagacggcacccccuuccauccauucgaaggccccgcccccauaggauuaccugaccuuggcggcugcgaccgacacaucaacaugacacaauucggucacucaucccaaacccaacacgacgcugacacaacccccgacaccagcgucccacaucucgguuccauccaagccaacggaauaggcuccggcaacuacgucgguguccucuccuggauauccccccccucccacccauccggaagccaagucgaccuauggaaaauccccaacuacggcuccucuaucaccgaagcaacccaccucgcaccaucgguuuacccccccggauucggcgaaguccucgucuucuucauguccaaaaugccaggccccggagccuacaaccuucccugccuccucccacaagaauacaucucucaucuugcaagcgaacaagcucccacaguaggugaagccgcccuccuucacuacgucgaccccgauacaggacgcaaccuaggcgaauucaaagccuacccagacggcuuccucacaugcguccccaacggcgccucauccggcccccaacaacucccaaucaacggcgucuucgucuucgucaguugggucucccgguucuaccagcucaaacccgucggcacagccuccuccgcacgcuaa

SEQ ID NO: 39386 - RNA, 1572 nt, Artificial Sequence
  derived and/or modified sequence opt11 from VP1__Norovirus_and/or_Norovirus-like__EF547392
augaugauggccaguaaagacgccaccucguccguagacggagccuccggugcgggccaacucguucccgaagucaaugcauccgacccccucgcuauggaucccguagccggcuccucuacagccgucgcaaccgccggccaagucaaccccaucgaccccuggaucaucaacaacuucguccaagccccccaaggcgaauucaccauaucaccaaauaacacccccggcgacguccuauucgaccucucccucggaccacaccucaacccauuccuucuacaccuaucccaaauguacaacggcugggucggaaacaugcguguacgcaucaugcucgcaggaaaugccuucaccgccggaaaaaucaucgucucuugcauuccaccagguuucggcucccacaaccucacaaucgcucaagcuacauuauucccccacgucauagcugacguccgcacacucgaccccauagaaguacccuuagaggacguacgcaacguccucuuccacaacaacgaccgcaaccaacaaaccaugcgccuagucugcauguuauacacaccccuacgcacgggcggcggcaccggcgacucauucgucguagccggccgcgucaugaccugcccaagcccagacuucaacuuucucuuccucguaccccccacagucgaacaaaaaacccgccccuucacacucccuaaccuuccccucuccucccuuucaaacucccgagcaccucuccccaucucaggcaugggcauuucucccgauaacguccaauccguacaauuccaaaacgggagaugcacucuagacggacgccucgucggcaccacccccguaucucucucccacguagccaaaauucgcggaacguccaacgguaccgugauaaaccuuaccgaacuugauggcaccccauuccaucccuucgaaggccccgcuccgauaggauuccccgaccucggaggcugcgacuggcacaucaacaugacucaauucggacacuccucccaaacacaauacgacgucgacaccacucccgacaccuucgucccacaccuuggcucuauucaagccaauggcgucuccucaggcaacuacaucggcguccucucaugggucuccccccccucacacccauccggcucccaagucgaucucuggaaaauccccaacuacgguucaucaaucacggaagcaacccaccucgcacccuccgucuacccccccggcuucggcgaaguccuugucuucuucaugagcaaaauccccggacccggcgccuacucucuccccugccuccucccucaagaauacaucucccacuuagcauccgaacaagcccccacugucggagaagccgcacuacuccacuacguugaccccgacacgggccgcaaccucggcgaauucaaagcuuaccccgacggcuuccucacaugcguacccaacggcgccagcuccggcccacaacaacuacccauaaacggcguuuucgucuucgucuccugggucucucgauucuaccaacucaaacccguaggcacagccuccacagcccgcuag

SEQ ID NO: 39387 - RNA, 1572 nt, Artificial Sequence
  derived and/or modified sequence opt11 from VP1__Norovirus_and/or_Norovirus-like__KT943503
augaugauggccuccaaagacgcaaccucaucuguagacggcgccuccggagccggccaacucguccccgaagucaacgccucagacccccucgcaauggaccccguagcaggcuccagcaccgccguagcuaccgcaggccaagucaacccaaucgacccauggauaaucaacaacuucguccaagcaccucaaggcgaauuuacaauaucccccaauaacacccccggcgauguccucuucgaccucucccucggcccucaccucaaccccuuccuccuucacuuaucccaaauguauaacgguugggucggcaacaugcgugucagaaucaugcucgccggcaaugccuucacagcagguaaaauaaucgucagcugcauacccccaggcuucggcucacacaaccucaccauagcacaagccacccucuucccccacguuauagcagacguccguacccucgaucccaucgaaguaccacucgaagacguccguaacguccucuuccacaacaacgaucgcaaccaacaaaccaugcgccucguaugcaugcucuacacaccccuccgcacaggaggcggcaccggagacuccuucgucgucgccggacguguaaugaccugccccucccccgacuucaacuuccuuuuccucgucccacccaccgucgaacagaaaacucgcccauucacccuccccaacuuaccacucagcucccuauccaauagccgagcaccccuacccauuuccucaaugggcaucuccccagacaacguacaauccguccaauuccaaaauggacgcugcacccuagacggccgucucgucggcacaaccccagucucucucucgcacgucgccaaaauccgaggcaccuccaacggcacaguaaucaaccucacugaauuagacggcacaccauuccacccauucgaaggcccagcucccaucggcuucccagaccucggaggcugcgacuggcacaucaacaugacccaauucggccacuccagccaaacccaauacgacgucgacacaacccccgacacauucgucccccaccucggcucaauacaggccaacggcaucggcucaggcaauuacgucgguguacucuccuggauuuccccacccucccaucccuccgggagccaagucgaccucuggaaaauccccaacuacggaucuucaaucaccgaagccacacaccucgcccccuccgucuacccacccggcuucggcgaaguccucgucuucuuuaugucaaaaaugcccggccccggcgcauacaaccuccccugccuacucccccaagaauauaucagccaccucgccagcgaacaagcccccaccguaggcgaagccgcccuuuuacacuacgucgacccugacacuggccgaaaucucggcgaguucaaagcauaccccgauggcuuccuaaccugcguacccaacggagccuccucuggcccucaacaacucccuauuaacggagucuucguauucgucucaugggucucccguuucuaccaacucaaaccagucggcaccgcuuccuccgcccgauaa

SEQ ID NO: 39388 - RNA, 1572 nt, Artificial Sequence
  derived and/or modified sequence opt11 from VP1__Norovirus_and/or_Norovirus-like__AY502016
augaugauggccuccaaagacgccaccucaaacgucgacggggccagcggcgcaggccaacucguacccgaagcaaauacaucggacccacucgccauggacccaguugcaggcuccuccaccgccgucgccaccgcgggccaaguaaacccaauagaccccuggaucaucaacaacuucguacaggcaccacaaggagaauuuaccaucucccccaacaacacccccggcgacguauuauucgaccuuucacucggcccccaccucaaccccuuccuccuccaccuaucccaaauguauaacggcuggguaggcaacaugcgagucagaaucaugcucgccggcaacgccuucacagccggcaaaaucauugucuccugcaucccacccgguuuuggcucucacaaccuuaccauagcccaauccacucuuuucccccacguaauagcagacguacgcacccucgaccccauugaagucccccuagaagacguacgaaacguccuuuuccacaacaacgaccgcaaucaacaaaccaugcgccuagucugcaugcucuauacaccccuccgcaccggcggaggaacaggcgacuccuucguuguagcaggccgcgucaugaccugccccucccccgacuucaacuuucuauuccucgucccacccacugucgaacagaaaacccgucccuucacccuuccaaaccuaccccucuccucacuuucaaacucccgugcaccuuuacccaucuccuccauggguaucucaccagacaauguccaauccguacaauuccaaaauggacgauguacucucgacggacgacuuguagguacaacgccagucucccucucucaagucgcaaaaauacgcggaaccucuaacggcaccgucaucaaccucaccgaacucgacggcaccccauuccaccccuucgaaggccccgcacccaucggcuucccugaccucggcggcugcgacuggcacguuaacaugacccaauucggccacuccucccaaacucaauucgacguugacaccacgcccgaaaccuucgucccccaccucggauccauacaagcuaacggaguaggcuccggcaacuacaucggaguccucuccuggaucucgccacccucacaccccagcggcucccaaguagaccucuggaaaaucccaaacuacggauccuccauaaccgaagcaacucaccucgcccccucggucuuucccccaggcuucggcgaaguucuugucuucuucauguccaaaaucccaggaccuggcgcauacaaccuucccugccuucucccccaagaauacaucucccacuucgccuccgaacaagcccccacagucggagaagcagcccuccuccacuauguugaucccgacaccggccgaaaccucggcgaauuuaaagccuacccagauggauuccuuaccugcgucccuaacggugccuccucaggcccccaacaacuccccaucaacggcgucuucguuuucguaagcugggucucccgcuucuaccagcucaaacccguaggcaccgcauccucagcccgcuga

SEQ ID NO: 39389 - RNA, 1572 nt, Artificial Sequence
  derived and/or modified sequence opt11 from VP1__Norovirus_and/or_Norovirus-like__KU253446
augaugauggccuccaaagaugccaccuccuccgucgacggcgccuccggugccggccaacucguacccgaagucaaugccuccgacccccuagcaauggacccagucgccggaucaucaacagcagucgccaccgccggccaaguuaaccccaucgaccccuggauaauaaacaacuucguccaagcaccccaaggcgaauuuaccauaucccccaacaacacccccggagacguacuauucgaccuguccuuagggccucaccuuaaucccuuccuccuucaccuaucacagauguacaauggauggguaggcaacaugcguguccgcauaaugcucgccggcaacgccuucaccgccggcaaaaucaucgucagcugcauucccccaggauucggcagccacaaccucaccauagcccaagcaacacucuucccucacguuauagccgacguccgcacccucgacccaaucgaaguaccccucgaagacguccguaacguacucuuccacaacaacgaccggaaccaacaaacaaugcgccucgucuguaugcucuacaccccacuccguacaggcggcggaaccggcgacuccuucgucgucgcaggccgaguaaugaccugucccucuccagacuucaacuuucuguuccucguaccacccaccguugaacagaaaacacgucccuucacgcuccccaaucuaccccucaguucccucucgaacucccgagcaccccuccccaucuccuccaugggcauaucccccgacaacguccaaucgguacaauuccaaaacggccgcugcacacuagacggacgccuagucggcaccacacccgucucccuaucccacguagccaaaauucgaggcaccuccaacggcaccgucaucaaucucaccgaacuugacgguacucccuuccacccguucgaaggccccgcccccaucggcuuccccgaccucggcgguugcgacuggcacaucaacaugacacaauucggacauuccucccaaacccaauacgacgucgacaccacaccagauacauucgucccccaccucggcuccauacaagcaaacggcaucgguucaggcaauuacgucggcguccuauccuggaucucaccucccucccaccccucaggcucacaagucgaccuuuggaaaaucccaaauuacggcuccuccaucaccgaagccacacaucucgccccauccguauacccacccgguuucggcgaaguccucguauucuucauguccaaaaugcccggucccggagcauacaaccucccaugccuccucccccaagaauacauaagccaccucgccuccgaacaagccccaacagucggcgaagccgcccugcuacacuacgucgaccccgacaccggccgcaaccucggcgaguucaaagcguacccagauggcuuccuaaccugcgucccaaacggcgcaucaucuggcccacaacaacuacccaucauaggcgucuucguauucgucuccuggguuucccgcuucuaccaacuaaaacccguaggcaccgcuagcuccgcacgcuaa

SEQ ID NO: 39390 - RNA, 1572 nt, Artificial Sequence
  derived and/or modified sequence opt11 from VP1__Norovirus_and/or_Norovirus-like__KU253445
augaugauggccuccaaagacgccaccucaucagucgacggggccuccggagccggacaacuuguucccgaagucaaugcaucagacccccucgccauggaccccgucgcaggcuccuccacagccgucgccaccgccggccaaguaaaccccauagaccccuggauaaucaauaacuucguccaagcaccucaaggagaauuuacuaucagccccaauaacacccccggcgacguccuauucgaccuaucacucgguccccaccuuaaccccuuccuacuccaucuaagccaaauguacaacggaugggucggaaacaugcgcguacgcauaaugcuugcaggcaacgccuucaccgccggaaaaaucaucguauccuguaucccacccggcuucggcagccauaaccucaccaucgcucaagccacacucuucccccacguaaucgccgacgucagaacacucgaccccaucgaaguaccccucgaagacguuagaaacguucucuuccacaacaaugaccgcaaccaacaaaccaugcgacucgucugcaugcucuacacaccccuccgcaccggcggcggcacaggcgacuccuucguuguagcaggccgcgucaugacaugccccucccccgacuucaacuuccuuuuccucgucccaccaacaguagaacagaaaacccgcccuuucacccucccaaacuuaccccuauccucucucucuaacagccucgcuccccucccaaucuccucuaugggcaucucccccgacaacguucaauccguccaauuccaaaacggccguugcacccucgacggccgacucgucgggaccacccccgucucccucagccacguagcaaaaauacgcggcaccuccaauggcacugucaucaaccucacagaacucgacggaacccccuuccaucccuucgaaggcccugcccccauaggauuccccgaccucggaggaugcgacuggcacaucaacaugacucaauucggacacuccucccaaacccaauacgaugucgacaccacccccgacacuuucgucccccaucuuggcagcauccaagcaaacggcauagguucaggcaacuacgucggcguacucucauggauaaguccacccucacaccccuccggcucccaagucgaccucuggaaaauccccaauuauggaagcucaaucacugaagccacucaucucgcccccuccgucuacccucccggcuucggcgaaguacucguuuucuucauguccaaaaugcccggccccggcgccuacaaccuccccugccuccuuccccaagaauacaucucccaccucgccagcgaacaagcacccaccgucggagaagcagcccucuuacacuauguggaccccgacaccgguagaaaccuaggcgaguucaaagcauaccccgacggcuuccucacgugcguccccaauggagccucaucgggcccacaacaacucccuaucaacggcgucuucguauucguaucaugggucucccguuucuaccaacuaaaacccgucggaaccgccucguccgcacgcuaa

SEQ ID NO: 39391 - RNA, 1572 nt, Artificial Sequence
  derived and/or modified sequence opt11 from VP1__Norovirus_and/or_Norovirus-like__KF039735
augaugauggccuccaaggacgccaccucaucaguagacggcgcaucgggcgccggccaacucguccccgaagucaacgcuuccgacccccucgcaauggaccccguggcuggaucaucaaccgcaguagcaaccaccggccaagucaaccccaucgacccauggauuaucaacaacuucguucaagcaccccaaggcgaguucaccauaucccccaacaacaccccuggagauguacucuucgaccucucccuagggccccaccucaaucccuuccuucuacaccucucacaaauguacaacggaugggucggcaacaugcgaguccgcaucaugcuugcaggcaacgcuuucaccgcaggaaagauaaucguauccugcaucccacccggcuucgguucccacaaccucacuauagcacaagcuacccucuucccccacgucaucgcagacgugcgaacacucgaccccauagaggucccccucgaagauguccgaaacguacucuuccacaacaacgaccgcaaccaacaaaccaugcgccuagucuguaugcucuacacaccccuacgaaccggcggcggcaccggagacagcuucguuguugccggccgcgucaugaccugcccaucccccgacuucaacuucuuauuccuaguacccccuaccguggaacagaaaacccggcccuucacccuaccaaaccuaccccuuuccucccucagcaacucacgcgcaccccuccccauaucuucgaugggcauaucacccgauaacguccaauccguccaauuccaaaauggacgcugcacccuugacggacgauuagucggcaccacccccgugagccuuucccacgucgccaaaauacgcggaacaucaaacggaaccguaaucaaccucaccgaacuagauggcacccccuuccaccccuucgaagguccugcgccuaucggcuucccugaccuaggcggcugcgacuggcacaucaacaugacccaauucggccacucuucacaaacccaauacgacguugacaccacacccgauaccuucgucccccaccuuggcuccauccaagcaaauggcaucggcucaggcaacuacgucggaguacuuucauggaucuccccacccucccaccccagcggaucccaagucgaccuauggaaaauacccaauuacggaucuucaaucacagaagcuacacaccucgcgcccuccguauacccacccggcuucggcgaaguccuagucuucuucauguccaaaaugcccggccccggagcauacaaccuccccugcuuacucccccaagaauacaucucccaccuugccucugaacaagccccaacagucggcgaagccgcccuccuccacuacgucgacccagacacaggccgcaaccucggcgaauuuaaagccuaccccgacggcuuccucacauguguucccaacggcgccucauccggcccccagcagcucccaaucaacggaguauucgucuucgucuccugggucucccgauucuaccaacucaaaccagucggcacagccuccucagcccgcuaa

SEQ ID NO: 39392 - RNA, 1572 nt, Artificial Sequence
  derived and/or modified sequence opt11 from VP1__Norovirus_and/or_Norovirus-like__KF039732
augaugauggcauccaaggacgccaccucauccguugacggcgcaucaggcgccggccaacucguacccgaaguaaacgcauccgauccucucgccauggaccccguagcaggcuccucaaccgcagucgccaccgccggacaagucaacccaaucgacccauggaucauaaacaauuucguccaagcuccccaaggagaauuuaccaucucccccaacaauaccccaggcgacguucuuuucgaucuaagccuaggcccccaccucaaccccuuccuccuucaccucucccaaauguacaacgguugggucggcaacaugcguguccgaauaaugcuagccggcaacgccuucacggcaggaaaaaucaucgucucauguaucccuccaggcuucggcucucacaaccucaccauagcacaagccacucuuuucccacaugucaucgcagacguacgcacacuugauccuauagaaguaccucucgaagacguacgcaacguucucuuccacaacaacgaucguaaccaacaaaccaugcgccuaguuugcaugcuauacacaccccuacguaccggcggaggcaccggagacuccuucgucguagcaggucgagucaugacuugcccuuccccugacuucaacuuccucuuccuaguacccccaaccgucgaacagaaaacucgacccuucacccucccaaaccucccccucuccucacuaucuaauucccgcgccccacuccccaucucauccaugggcaucucccccgacaacguccaauccguacaauuccaaaacggccgcugcacccuagacggacgccucguaggcaccaccccagucucccuaucgcaugucgcaaaaaucagaggaaccucaaacgguacagucauuaaccucacugaacucgacggcacccccuuccaccccuucgaaggcccugccccaauaggcuuccccgaccucggaggaugcgacuggcacauaaauaugacccaauucggccacuccucacaaacccaauacgacgucgauaccaccccagucaccuucguaccacaccuaggcucaauccaagcaaacggcaucgguucaggcaacuacguaggcguccucucauggauaucaccucccucacaccccuccggcucucaagucgaccuuuggaaaauacccaacuacggcuccucuaucaccgaagcuacccaucucgccccuucugucuacccacccgguuuuggugaaguccucgucuucuucauguccaaaaugccagguccaggcgcauacaaccuccccugccuccuaccacaagaguacauaucccaccucgcauccgaacaagcccccaccgucggcgaagcggccuuacuacacuacguagaccccgacaccggccgaaaccucggcgaguucaaagcauacccagauggcuuccuaacaugcguccccaacggcgccuccuccggaccucagcaacuucccaucaacggaguuuucgucuucgucuccuggguuucccgcuuuuaccaacuuaagcccgucggcacagccuccucagcccgauaa

SEQ ID NO: 39393 - RNA, 1572 nt, Artificial Sequence
  derived and/or modified sequence opt11 from VP1__Norovirus_and/or_Norovirus-like__KF039734
augaugauggcauccaaagacgccacuuccuccgucgacggggccuccggcgcaggccaacucgucccagaaguaaacgccuccgacccccuagcaauggaucccgucgccgguucuuccaccgccgucgcgacagccggacaagucaacccuaucgaccccuggauaauaaacaacuucguccaagcaccacagggcgaguucaccaucucccccaacaacacacccggagacguucucuucgaccucucgcucggaccccaccuaaacccauuccuccuacaccuaucccaaauguacaacggcugggucggaaacaugcgggucagaaucaugcucgccggcaacgccuucacugccggaaagaucauugucucuugcaucccucccggcuucggcucacacaaccuuaccaucgcccaagcaacccucuuuccccaugucauagcagacguacgaacccuugaccccaucgaaguaccccucgaagacguccgaaacguccucuuccacaacaacgaccgaaaccaacaaacaaugcgccucgucugcaugcucuacacgccccuccgcacaggcggaggaaccggcgacuccuucgucgucgccggacgcgucaugaccugccccucccccgacuucaacuuccucuuccucguaccucccacagucgaacagaaaacccgucccuucacacuccccaaccugccccucucuucacuguccaacucacgcgcaccccucccaauaucauccaugggaauaucuccagacaacguccaaucaguacaauuccaaaacggucgcuguacacucgauggccgccucgucggcaccacacccgucucccuuucacacgucgcaaaaauacgagguaccucaaacggcacaguaaucaaccucacagaacuagacggcacccccuuccaucccuucgaaggcccggccccaaucggcuucccggaccuaggaggaugcgacuggcacaucaacaugacacaauucggccacucuagccaaacccaauacgacgucgacaccacccccgacaccuucgucccccacuuaggcuccauccaagccaacgguaucggaucaggcaacuacgucggaguccucuccuggaucucaccucccucccgucccuccggaucccaaguggaccucuggaaaauacccaacuacggcuccuccaucacagaagcaacccaccucgcgcccucagucuaucccccaggcuucggagaaguucucgucuucuucaugucaaaaaugcccgguccaggagcauacaaccuacccugccuacugccccaagaauacaucucccaccuagccuccgaacaagcaccaacagucggcgaagcagcacuccuacacuacguagaccccgacaccggucgaaaccuaggcgaguucaaagccuaccccgacgguuuccuuaccugcguccccaacggagcauccagcgguccacaacaacucccaaucaauggcgucuucgucuucguauccugggucucacgauuuuaccagcucaaaccagucggcacagcaucauccgcccguuaa

SEQ ID NO: 39394 - RNA, 1572 nt, Artificial Sequence
  derived and/or modified sequence opt11 from VP1__Norovirus_and/or_Norovirus-like__KF039729
augaugauggcuuccaaagacgcaacuuccuccgucgacggcgcaucgggagcaggucagcucguuccugaagugaacgcauccgacccccuagcaauggaccccgucgccggcagcuccaccgcagucgccaccgccggccaagucaaccccauagaccccuggaucaucaacaacuucguccaggcuccacaaggcgaauuuacaauauccccaaacaacaccccaggcgauguucuuuucgaucuuucccucggaccucaccucaaccccuuccuacuccaucucucacagauguacaacggcugggucggcaacaugcgcguaagaaucaugcuagcaggcaacgccuuuacugcaggcaagaucauagucuccugcauacccccuggcuuuggcucacacaaccuaaccaucgcccaagcuacucuauucccgcacgucaucgcugacguacgcaccuuagacccaauugaaguaccccucgaagacguccguaacguacucuuccacaacaaugaccgcaaucaacaaaccaugcgccuagucugcaugcucuacacuccccuccgcaccggaggcgguaccggcgacucauucguaguugcuggccgaguuaugaccugccccucacccgacuucaacuuccucuuucucguacccccuaccgucgaacagaaaacccgccccuucacccucccaaaccucccacuauccucacucuccaauucucgcgcucccuuacccauaagcagcauggguaucuccccagacaacguccaauccguccaauuccaaaacggucgcugcacccucgacggucgcuuagucgguaccacacccgucucucucucccaugucgccaaaauucgcggcacauccaacggcaccgucauaaaucuaacggaacuagacggcacacccuuccaucccuucgaaggacccgcacccaucggcuucccagaccucggagguugcgauuggcacaucaacaugacucaauucggucacuccucccaaacacaauaugacgucgacaccacacccgacaccuucgucccccaccuuggcucgauccaagccaauggcguaggcuccggaaacuacgucggcguccuuucauggaucucacccccuagccacccauccggcucccaaguggaccucuggaaaauccccaacuauggcucaucaaucacagaagccacccaccucgcccccucagucuacccacccggcuucggcgaaguccugguauucuucaugucaaagaugcccggacccggcgccuauaaccuccccugccuacuaccccaagaauacaucucccaccucgccucagaacaagcacccacuguaggcgaagccgcccuccuccacuacgucgacccugacacuggccgcaaccuaggagaauuuaaagcauauccagacggcuuccugaccugcguccccaacggcgcaagcuccggaccccaacaacuacccauuaauggcguguucgucuucguauccugggucucacgcuuuuaccaacucaaacccgucggcaccgcaucaagcgcucgauaa

SEQ ID NO: 39395 - RNA, 1572 nt, Artificial Sequence
  derived and/or modified sequence opt11 from VP1__Norovirus_and/or_Norovirus-like__KF039737
augaugauggccuccaaagacgccaccucuuccgucgacggagccuccggagccggccagcuuguacccgaaguuaacgccuccgacccacuugcaauggaccccgucgccggcucaucaacugcugucgccaccgcaggccaggucaaccccaucgaccccuggaucaucaacaacuucguccaagcaccccaaggagaguucaccaucucccccaacaacacccccggagacguccuauucgaucuaagucucggaccucaccuuaacccuuuccuccuccaccuaucccagauguacaacggcugggucggcaauaugagaguccgcaucaugcucgccggcaacgccuucaccgcagguaaaauaaucgucuccugcaucccacccggcuucgguucucacaaccuaaccaucgcacaagccacacuauucccccacgucaucgccgacguccgcacccuagaccccauugaagucccacuugaagacguacgcaacguccucuuccacaacaacgaccgaaaccaacaaaccaugcgacucguaugcaugcucuacacaccccuccguaccggaggagguaccggcgacuccuucgucguagcaggacgcgucaugacgugcccguccccagacuucaacuuccucuuccucguaccaccuaccgucgaacagaaaacuagacccuucacacuaccuaaccucccccucuccucacuaucaaacagccgcgcuccucuccccaucucuucuauggguauaucacccgacaacguucaaucaguacaauuccaaaacggccgcugcacucucgacggccgccucgucggaaccacccccguuucccucucccacgucgccaaaauacgaggcacaucaaacggaaccgucaucaaccucacugaacuagacgguacucccuuccaccccuucgaagguccagcaccuauaggcuucccagaccucgggggaugcgacuggcacauaaacaugacccaauucggccacucaucacaaacccaauacgacgucaauacaacuccggacacauuuguaccccaccuaggcucaauacaagccaacggaauuggcucaggaaacuacgucggcguccuuuccuggauauccccacccucacaccccuccgggagucaagucgaccucuggaaaauccccaauuacggcuccuccaucaccgaagcaacccaccucgcacccucuguauauccacccggcuucggagaaguccuugucuucuucauguccaaaaugcccggccccggcgccuacaaccuccccugccuccucccccaagaauacauaucccaucucgccucggaacaagcacccaccguaggagaagccgcacuacuacauuacgucgaccccgacaccggccgcaaccuaggcgaguucaaagccuacccugacggauuucuaaccugcguccccaacggcgccuccuccggcccccaacaacucccaauaaacggagucuucguauucguuuccugggucagccguuucuaccaacucaaaccugucggcaccgccuccucagcacgcuag

SEQ ID NO: 39396 - RNA, 1572 nt, Artificial Sequence
  derived and/or modified sequence opt11 from VP1__Norovirus_and/or_Norovirus-like__KF039731
augaugauggcauccaaagacgcuaccuccuccgucgacggugccuccggcgcaggccaacucgucccagaagucaaugccuccgacccacucgccauggaucccguugccggcucauccaccgccgucgcuaccgcuggucaagucaaccccaucgaccccuggaucaucaacaacuucguccaagcaccccaaggcgaguucaccauaucacccaacaacacuccuggcgacguccuauucgaccucagcuuaggaccccaccuuaaccccuuccuucuucaccucucccaaauguauaacggcugggucggaaauaugagaguccgcaucaugcucgccggcaacgccuuuaccgccggcaaaaucauugucucaugcauucccccaggcuucggcagucacaaccuaaccaucgcccaagcuacacucuucccacacgucaucgccgacguccgcacccuagacccaaucgaaguaccacuagaagacguccguaacguccuguuccacaacaacgaccgcaaccaacaaacaaugcgacucgucugcaugcucuacaccccacuucgcacuggcggcggaacuggcgacuccuucguagucgccggucgcguaaugaccugucccucucccgacuucaacuuucuauuccucguacccccaaccguugaacaaaagacccgacccuucacccuacccaaucucccccucuccucccucuccaacucccgagcaccccuacccaucagcucgauggguaucucccccgauaacguacaaucuguccaauuccaaaacggccgcugcacacucgauggccgacucgucggcaccacacccguaucacucucccacgucgccaaaauccgcggcacaucaaacggaaccgucauaaaccucaccgaacuagacggcacccccuuccacccauucgaaggaccagcccccaucggauucccggaccucggcggcugcgacuggcacauaaacaugacucaauucggccacuccucccaaacccaauacgacguagacaccacucccgauaucuucgucccacaccucggguccauccaagccaacggaaucggaucuggcaacuacgucggcguucuaucauggaucuccccacccucccacccuucuggcucccaagucgacuuauggaaaauuccuaauuacggcuccuccaucacugaagccacccacuuagcaccauccguauacccucccggauucggcgaaguccucgucuucuucauguccaaaaugccuggccccggcgccuacaaccucccuugcuuacuaccgcaagaauacauaucacaccuagccucagaacaagcacccacagucggcgaagccgcacuacuacacuacgucgacccagacacuggacgaaaccuuggagaauuuaaagccuaccccgacggauuccuaaccugcguccccaacggcgccucaucaggcccccaacaacuccccauaaacggcgucuucgucuucguaucaugggucucccgcuucuaccaacucaagcccgucggcaccgccuccuccgcccgcuaa

SEQ ID NO: 39397 - RNA, 1563 nt, Artificial Sequence
  derived and/or modified sequence opt11 from VP1__Norovirus_and/or_Norovirus-like__KT732279
augaugauggccucaaaagaugcaacaucaagcguggacggcgccuccggugcaggccaauuaguccccgagguuaacgcaucugacccccucgcaauggaccccguugccgguuccucaaccgccgucgcaaccgccggccaagucaaucccauagaccccuggaucauaaacaauuucguccaagcaccccagggcgaauuuacaaucuccccaaacaacacccccggcgacguacuauucgaucucucccucggcccccacuuaaaucccuuccuccuccaccuuucccaaauguauaacggaugggucggcaacaugcgaguaagaauaaugcucgcaggcaacgcauucaccgccgguaagauaauaguaucaugcaucccucccggcuucgguucacacaaccucacaaucgcucaagccacacucuucccccacguuaucgccgacguccgaacccucgacccaaucgaagugccacucgaagacguacgaaacguccuauuccacaacaacgaccgcaaccaacaaacuaugcgccucgucugcaugcucuacaccccacuucgcaccggcggcggcaccggagauucccuaguagucgcaggccgcgucaugaccugcccgagccccgacuucaacuuccucuuccucguacccccaaccgucgaacagaaaacccgccccuucacucuacccaaccuuccccuuuccucacucuccaacucacgcgcaccccuccccaucagcggaaugggcaucucacccgacaacguccaaucaguccaauuccaaaacggacgcugcacccuagacggcagacucgucggaaccacuccaguaucccuaucacacgucgccaaaauccgaggcaccuccaacggcacugucauaaaccucacagaacucgacggaaccccauuccaccccuucgaaggacccgcccccauaggcuuccccgaccugggaggcugcgauuggcacaucaacaugacccaauucggccacucaucucaaacccaguacgacgucgacacaacccccgauacauucgucccccaccuaggcuccauccaagccaacggcauaaacuccggaaacuacaucggcguccucuccugggucucgccacccucccaccccuccggcucccaaguagaccuguggaaaauccccaacuacggaucuuccauaacagaagccacacaccucgcccccagcgucuucccacccggcuucggcgaaguccuaguauucuucauguccaaaauacccggccccggcgccuacucccuccccugccuucucccccaagaauacauaucucaccuagccuccgaacaagccccaaccguaggcgaagccgcacuacuccauuacguagacccagacaccggucgcaaccucggagaguucaaagccuaccccgacggauuccucacuugcguaccaaacggcgcguccucagggccccaacaacuaccuauaaacggcgucuuuguauucgucucaugggucucccgauucuaccaacucaaacccgucggcaccgccuccuaa

SEQ ID NO: 39398 - RNA, 1563 nt, Artificial Sequence
  derived and/or modified sequence opt11 from VP1__Norovirus_and/or_Norovirus-like__FJ384783
augaugauggccuccaaggacgcaaccuccagcgucgacggagccucaggcgccggccagcuaguccccgaagucaacgcauccgacccccuagcaauggaucccgucgcaggauccuccaccgccguugcuaccgcaggucaagucaaucccaucgacccuuggaucauuaacaacuucguccaagcaccccaaggugaguucaccaucuccccaaacaacaccccaggcgacguccucuucgaccucucguuaggcccccaccuuaaccccuuccuccuccaccucucccaaauguacaacggcugggucggaaacaugcgcguacgcaucaugcuugccggcaacgccuucaccgcuggaaaaauuaucguauccugcauacccccaggauuuggcucccacaaccuaaccaucgcccaagccacacuauucccccacgucaucgcugauguucgcacacuagaccccaucgaagucccacuagaagaugucagaaacguccucuuccacaacaacgaucgcaaccaacaaaccaugcgccucgucugcaugcuuuacacuccccuacguaccggaggcggcacaggcgacucuuucgucguugccggccgcguuaugaccuguccaucccccgacuucaacuuccucuuucucguucccccgacggucgaacagaaaacucgcccauucacacuccccaaccucccgcucucuucgcuuucuaacucacgcgcaccccuacccaucuccgguaugggcaucucccccgacaacguccaaucaguccaauuccaaaacggccguuguacccucgacggucgccucgucggcaccaccccagucucccuaucccacgucgccaaaauccgaggcaccucuaacggaacagucauaaaccuuaccgaacuugacggaaccccauuccaccccuucgaaggcccagccccuaucggcuuccccgaccuuggcggcugcgacuggcacaucaacaugacacaauucggccacucaucccaaacacaauacgacgucgacacaacccccgacacauucguuccacacuuaggcucuauccaagcaaacggcaucaacucuggcaacuacaucggcguccucuccugggucuccccucccucccaccccagcggcucccaaguugaccucuggaaaauacccaacuacggaucauccaucaccgaagccacccaccucgcccccuccgucuucccucccggguucggcgaaguucuagucuucuucauguccaaaauccccggcccaggugcauacucacuacccugccuacuaccccaagaauacauaucccaccuagccuccgaacaagccccuacuguaggcgaggccgcacuucuacauuacguugauccugacaccggcagaaaccucggcgaguucaaagccuaccccgauggcuuccugacaugcguaccaaacggcgccucauccggcccccaacaacuucccauaaauggcguauucgucuucguauccugggucucccgcuucuaccagcucaaacccguaggaaccgcaucauaa

SEQ ID NO: 39399 - RNA, 1563 nt, Artificial Sequence
  derived and/or modified sequence opt11 from VP1__Norovirus_and/or_Norovirus-like__EU085522
augaugauggccuccaaagacgcaacauccucaguagacggcgcuucaggagccggccaacucguacccgaaguaaacgcauccgacccacuagccauggaccccgucgccggauccuccaccgcugucgcaaccgccggccaagucaaccccauagauccguggaucauuaacaacuucguccaagcaccccaaggcgaauuuaccaucucacccaacaacacccccggagacguccuuuucgaccugucacuaggcccccaccucaacccuuuccuccugcaccucucccaaauguacaacgguugggucggcaauaugcgaguccgcaucaugcuugccggcaacgcuuucaccgccggaaaaauuaucguaucuugcauacccccaggcuucggcucccacaaccucacuaucgcacaagccacccuauucccccacgugauugccgacguacgaacacucgaccccaucgaagucccccucgaagaugucagaaauguccuauuccacaacaacgaccgcaaccaacaaacgaugcgacucgucugcaugcucuacacaccccuccgcaccggcucaggcaccggcgacucauucguagucgccggucgcguuaugaccugucccuccccagauuucaacuuccucuuccuaguaccacccacagucgaacagaaaacgcgacccuucacacuccccaaccucccccucagcucccuuuccaacucccgcgcaccccuccccauaucgggcaugggcaucucaccagacaacguacaaucaguccaauuccaaaacggccgaugcacgcucgacgggcgacucgucggcaccacccccgucucccuuagccaugucgccaaaauacgaggaaccuccaacggcaccgucauaaaccuaaccgaacucgacggcacccccuuccaucccuucgaaggacccgccccaauaggcuuccccgaccucggcggcugcgacuggcacaucaacaugacccaauucggccacucuucacaaacacaauacgacgucgacaccacaccugauaccuucguaccccacuuaggcucuauccaagcaaacgggaucaacucgggcaacuacaucggcguccucuccuggguauccccucccucccaccccuccggcucccaaguugaccuauggaagauucccaacuacggcucaucaaucaccgaagcaacccaccucgcccccucagucuucccacccggcuucggcgaagugcucguuuucuucauguccaaaauaccaggccccggcgccuacagccuccccugccuccucccccaagaauacauuagccaccuagcuuccgaacaagcccccaccgucggcgaagccgcccuacuccauuacgucgaccccgacacaggccgcaaccucggcgaauuuaaggcuuaccccgacggauuccuuaccugcgucccuaacggcgccuccucuggaccccaacaacucccaaucaacggugucuucgucuucguuucuugggucucucgcuucuaccaacucaagcccgucggcacagccucauaa

SEQ ID NO: 39400 - RNA, 1563 nt, Artificial Sequence
  derived and/or modified sequence opt11 from VP1__Norovirus_and/or_Norovirus-like__L23828
augaugauggcauccaaagacgccacauccuccguagacggagccucagcaucaguucaacucguacccgaagucaacgccucagacccccucgccauggaccccgucgcaggaucauccaccgcagucgcaaccgcaggccaagucaaccccaucgacccauggaucaucaacaacuucguacaagccccacaaggcgaguucacaaucucccccaacaacaccccaggcgacguacuuuucgaccucucucucggcccccaccucaauccauuccuccuacaccucucccaaauguacaacggauggguuggcaacaugcgcgucagaaucaugcucgccggcaacgccuucacugccggcaaaaucaucguaucaugcauuccacccggauuuggcucucaacaacucacaaucgcccaagcgacccucuucccccacguaaucgcugacguucgaacccucgacccuauagaagugccccucgaagacgucagaaauguccuauuccacaauaacgaccguaaccaacaaacaaugcgacucguaugcaugcuuuacaccccacucuccaccggcggaggcaccggcgacuccuucguugucgccggacgcguaaugaccugccccuccccagacuucaacuuccuauuccucguacccccuaccgucgaacagaaaacccgccccuucacacuccccaaccuuccccuauccucccuguccaacucucgcgcaccacucccuaucuccggcaugggcaucucccccgacaacguccaaucaguccaauuccaaaacggccgcugcacccucgacggacgccuugucggcaccaccccugucucccuaucacacgucgcaaaaauccgugguacgucaaacgguaccgucaucaaccuuacagaacucgacggcacccccuuccacccauucgaaggaccagcacccaucggcuuucccgaccucggcggaugcgacuggcacaucaacaugacacaauucggacacucgucgcaaacccaauacgacgucgauaccacccccgacaccucuguuccccaccucggcuccauccaagcaaacggcaucggcuccggcaacuacauaggcguccuauccugggugucuccaccaucacaccccagcgggucucaaguugaccuauggaaaauccccaacuacggauccuccauaacagaggccacccaucuugcccccuccgucuacuccccaggauucggcgaaguccugguauucuucaugagcaaaaucccaggcccaggaggcgacucgcuaccuugccuacucccacagggcuacaucucccaccucgcuucugaacaagcuccaaccgucggugaaggaccccuccuccauuacgucgacccagacacugacagaaacuuaggcgaguucaaagccuacccagacggcuuccuaaccugcgucccuaacggugcaucaucaggaccacaacaacuccccauaaauggcgucuucgucuucgucagcugggucucaagauucuaucaacucaagcccgucggaacagccuccuaa

SEQ ID NO: 39401 - RNA, 1563 nt, Artificial Sequence
  derived and/or modified sequence opt11 from VP1__Norovirus_and/or_Norovirus-like__KX764843
augaaaauggcaucuaacgacgcagcacccuccaacgacggcgccgccggccuaguaccagaaggcaacaacgaaacccucccacuagaaccugucgccggcgccgccaucgcagcacccgucaccggccaaaauaacauaauagacccguggauccguaccaacuuuguacaagcccccaacggcgaauuuaccgucucaccccgcaacucucccggcgaagucuuacuuaaccucgaacuaggaccugaccucaaccccuaccucgcccaccuuucccgaauguacaacgguuacgcuggcggugucgaaguccaaguacuacuagccgguaacgccuucaccgccggcaaaauucuauucgccgccgugccacccaacuuccccguggaguuccuuucccccgcacaaaucaccaugcuuccccaccuaauagucgacguacgaacacuugaacccaucaugaucccccuccccgacguccgaaacacuuucuuccacuauuccaaccaacccaacucccgcaugagacucguugcaaugcucuacacccccuuacgauccaacggcuccggagacgacgucuucaccguaucaugccgcguccucacccgccccacccccgacuucgaguucacauaucuaguacccccguccgucgaaucaaaaacuaagcccuucucccucccaauccuaacucuuucagaacucaccaacucccgcuuccccguccccaucgacucccucuucacagcacaaaacaacguccuacagguccaaugccaaaacggacgcugcacucucgauggagaacuacaaggcaccacccaacuccucccauccgguaucugcgccuuuagaggccgagucaccgcccagaucaaccaacgcgaccgcuggcacaugcaacuccaaaaccucaacggcaccaccuacgaccccaccgaugacguaccugcaccucucgggacgcccgauuucaaaggcguaguauucggcaugguuucccaacgcaacguaggcaacgacgcccccggcuccacaagagcucaacaagccugggucuccaccuacaguccccaauuuguucccaaacuuggaagcguaaacuuacgcauaucagacaacgacgacuuccaauuccaacccacaaaauucacccccgucggcgucaacgacgacgacgacggccacccauuccgccaaugggaacucccuaacuacagcggcgaacucacccucaacaugaaccuugcaccaccagucgcccccaacuuccccggugaacaacuccucuucuucagauccuucguacccugcuccggcggcuacaaccagggcauaaucgacugcuuaaucccccaagaauggauccaacacuucuaccaagaauccgcccccucacaaucggacguugcccuaaucagauacgucaaccccgacacaggccgaacccucuucgaagcuaaacuccaccgcucuggauacaucacggucgcccauucaggcgacuacccacucgucguacccgccaacgggcacuuccgauucgaugccugguaa

SEQ ID NO: 39402 - RNA, 1563 nt, Artificial Sequence
  derived and/or modified sequence opt11 from VP1__Norovirus_and/or_Norovirus-like__KX764841
augaaaauggccuccaacgacgccgcacccuccaacgacggcgccgcaggccuaguacccgaaggcaauaacgaaacacuuccacucgaaccugucgccggcgccgcuauagccgccccgguaaccggccaaaacaacauaauagacccauggauucgcacaaauuucguacaagcccccaauggcgaauuuaccguauccccacgcaacuccccaggagaaauccuucucaaccuagaacuuggacccgaccucaaccccuaccucgcacaccuaucccgaauguacaacggcuacgccggcggcguagaaguacaaguccuacucgccggcaacgccuucaccgccggcaaaauccuauucgcagccguuccacccaacuucccaguggaauuucuaucacccgcccaaaucaccaugcuaccccaccuaaucguggacguccgcacacuagaaccuaucaugaucccccuccccgacguccgaaacacuuucuuccacuauucuaaucaaccaaacucucgaaugcgacucgucgccaugcuauacaccccacuacgcuccaacggaucaggcgacgacgucuucaccgucuccugccgcguacugacccguccuacccccgauuucgaguucaccuaccucgucccucccuccgucgaauccaaaaccaagccauucuccuuacccauccuaacccucucagaacucaccaacucacgcuuccccguaccaauagacagccuuuucacugcccaaaacaacguacuccaaguccaaugccaaaacggccgcugcacccucgacggcgaacuacaaggcaccacacaacuccuccccuccggcauaugugccuuccggggccgagucacugcccaaaucaaccaacgagaccgcuggcgcaugcaacuacaaaacuuaaacgguacgacauacgacccaaccgacgacguccccgccccacucggcacccccgacuucaaaggcguuguauucggaaugguaucacaacgcaacguaggcaacgacgcccccggcuccacacgugcucaacaagcaugggucuccaccuacuccccucaauucgucccaaaacucggaucagucaacuuaagaaucagcgacaacgacgacuuccaauuccaacccaccaaauucaccccagucggcgucaacgacgaugacgacggacacccauuccgacaaugggaacucccuaacuacagcggcgaacucacacucaauaugaaccucgccccucccguagcgcccaacuuccccggcgaacagcuccuguucuuccgcucauucguccccugcagcggaggcuacaaccaaggaaucaucgacugccucauaccccaagaauggauacaacacuucuaccaagaauccgcucccagccaaucugacgucgcccuaauccgcuacgucaaccccgacaccggacgcaccuuauucgaagccaaacuccaccgcuccggcuacauaaccguugcccacucaggcggauacccacuggucguccccgccaacggccacuuucgauucgaauccugguaa

SEQ ID NO: 39403 - RNA, 1563 nt, Artificial Sequence
  derived and/or modified sequence opt11 from VP1__Norovirus_and/or_Norovirus-like__KX764840
augaaaauggcauccuccgacgccgcaccaucuaacgacggagcagccggccucgucccugaaggaaacaacgaaacccucccacuagaacccgucgccggagccgcaaucgcagcccccgucaccggccaaaacaacaucaucgacccuuggauccgcaccaacuucguacaagcccccaauggagaauuuacagucucgccacgaaacucuccaggugaaauacuccuaaaccucgaacucggccccgaucucaaucccuaccuagcccaccuaucucgcauguacaacggcuacgccgguggcguagaaguccaagucuuauuagccggaaacgcauucaccgcugguaaaauccucuucgcggcaguaccgcccaacuuccccgucgaauuucuaucccccgcccaaaucacaaugcucccccaccuuauugucgacgugcgcacccuagaacccauaaugauaccccuacccgacguacggaacacauucuuccacuacuccaaccaaccaaauucacgcaugcgucuggucgcuaugcucuauaccccucuacgauccaauggcucaggagacgacgucuucacagucuccugccgcguccucaccagacccacccccgacuucgaguucaccuaccucgucccaccauccgucgaauccaagacaaaacccuucucucuaccaauccuaacucucuccgaacucaccaacucccguuuccccguccccauagacucucuauucaccgcucaaaacaacguccuccagguccaaugccaaaacggccgcugcacccucgacggcgaacuccaagguaccacccagcuccuaccaucaggaaucugcgccuuccgcggacgcgucaccgcacagaucaaccaaagagaccgcuggcacaugcaacuucaaaaccucaacggcaccacauacgacccaacugacgacguccccgccccacuuggcacccccgacuucaaaggagucgucuucggcauggucucccaacguaacgucggcaacgacgcccccggaucaacccgcgcccaacaggccuggguauccaccuacucaccccaauucguccccaaacucgguuccgucaaccugcgcaucuccgacaacgacgacuuccaguuccaacccaccaaauucacccccgucggugucaacgacgaugacgauggccaccccuuccgccagugggaacuacccaacuacuccggcgaauuaacccucaauaugaaccuagccccacccguagcccccaacuuucccggcgaacaacuccucuucuuccgaaguuucguccccugcuccggcggcuacaaccagggcauaaucgacugucucaucccacaagaauggauccaacacuucuaucaagaaagcgccccuucccaaucggacguagcccuuauccgauacgucaaccccgacaccggccgaacccuauucgaagccaaacuccaccgcuccggcuacaucaccgucgcacacuccggcgacuauccccuagucguacccgccaauggccacuuccgauucgacuccugguaa

SEQ ID NO: 39404 - RNA, 1563 nt, Artificial Sequence
  derived and/or modified sequence opt11 from VP1__Norovirus_and/or_Norovirus-like__KT864687
augaaaauggcauccaacgacgccgcaccauccaacgacggagccgccggccucguucccgaaggcaauaacgaaacccucccccuagaacccgucgccggugcagccaucgcugcacccguaacaggccaaaacaauauaauagaccccuggaucagaaccaacuucguccaagcacccaacggcgaauuuaccgucucuccccgcaacagccccggcgaaauccuacucaaccucgaauuaggacccgaccucaacccauaccucgcccaccucucaagaauguacaacggauacgccggcggaguagaaguacaaguccuccucgccggcaacgcauucaccgccggcaaaauacucuucgcagcaguaccaccuaacuucccugucgaauuucuaucacccgcacaaauuaccaugcuaccccaccucaucguagacguccgcacccuagaacccauaaugauaccccuaccggauguccgcaacacguucuuccacuacucgaaccaacccaauucccgcaugcgccucgucgcgaugcucuacacaccccuacgcucaaauggaaguggagacgacgucuucacaguaucaugcagagugcuaacccgacccacacccgacuucgaguucaccuaccucgucccacccuccguggaaucaaaaacaaaaccauucucacuccccauacuaacccucucagaacucaccaacucuagauuccccgucccuauugacucucucuucaccgcccaaaacaacguccuacaggugcaaugccaaaacggccgauguacacuagacggagaacuccaaggcaccacacagcugcuccccagcgguaucugcgccuuccgcggacguguaaccgcccaaaucaaccaacgcgaccguuggcacaugcaacuacaaaaccucaacggcaccacauacgacccaacagacgacgucccagcaccccucggcacccccgacuucaaaggcguuguauucggaauggucucacaacgcaacguagguaacgacgcccccggcuccaccagagcccaacaagccugggucuccaccuacaguccccaauucguaccaaaacucggcucaguaaaccuccguaucuccgacaacgacgacuuccaauuccaacccaccaaauucaccccagucggcgucaaugacgaugacgacggacaucccuuccggcaaugggaacuccccaacuacuccggcgaacuaacacuaaacaugaaccucgccccacccgucgcccccaacuucccaggugaacaacuacucuucuuccguucuuucguacccugcuccggcggcuacaaccaaggcaucauagacugccuaaucccacaagaauggauccaacacuucuaccaagaauccgcccccucucaauccgacgucgcccucauccgcuacgugaaucccgacacaggacguacccucuucgaagccaaacuccaccgcucaggcuacaucacagucgcccacucaggcgacuacccccucguuguccccgccaacggccacuuccgcuucgaauccugguaa

SEQ ID NO: 39405 - RNA, 1563 nt, Artificial Sequence
  derived and/or modified sequence opt11 from VP1__Norovirus_and/or_Norovirus-like__KX764842
augaaaauggcaucuaacgauguggcaccuuccaacgacggagcagccggacucguaccugaaggaaauaacgaaacccuaccccuagaaccagucgcaggggccgccauugcagcccccgucaccggucaaaacaauaucauagaccccuggauacgcaccaacuucguccaagcccccaauggagaauuuaccgucucuccccgaaacucccccggcgaaauccuacuuaaccucgaacucggccccgaccucaaucccuaccuagcccaccuuuccagaauguacaacggcuacgccggaggcgucgaaguccaaguccuccucgcaggcaacgccuucaccgccggaaaaauucucuucgcagccguaccacccaacuuccccguagaauuucucucccccgcccagaucacuaugcuaccccaucucauagucgacguccguacacuagaacccaucaugaucccauuacccgacguccgaaacaccuucuuccacuacuccaaccaacccaacucgcggaugcgacucgucgccaugcucuacacuccccuccgcuccaauggcuccggcgacgacgucuucacugucuccugccgaguccucacccgucccacccccgauuucgaguucacauaccucgucccacccucagucgaaagcaaaaccaaacccuucagucuccccauccuaacccucucagaacuaacaaacucacgcuuucccguccccaucgacucacucuucacagcucaaaacaacguacuccaaguccaaugccaaaacggccgcugcacccucgacggagaacuacaaggcacuacccaacuacuccccucaggcaucugcgccuuccguggccggguaacagcccaaaucaaccaacgagaccgcuggcacaugcaacuacaaaaccuaaacgguacuacuuacgaucccaccgacgacguccccgccccacuuggcaccccugauuucaaaggcgucgucuucggcauggucucccaacgcaaugucggcaacgacgcccccggcucgacccgcgcccaacaagccugggucuccacauacuccccacaauucguccccaaacucggcucugucaaccuccgcauauccgacaacgacgacuuccaauuccaacccaccaaauucaccccagucggggucaacgacgacgacgacggacaccccuuccgccaaugggaacuacccaacuacucaggcgaacuuacccucaauaugaaccuagcacccccagucgcccccaacuuccccggagaacaacuccucuucuuccguuccuucguuccaugcuccgggggcuauaaccaagguaucauagacugucucaucccccaagaauggauccaacacuuuuaccaagaaucugcccccucucaaucugacgucgcccucauccgauacgucaauccagauaccggccguacacucuucgaagccaagcuccaccgcuccggauacaucacagucgcccacucaggcgacuacccccuugucguuccagccaacggacauuuccgauucgacgccugguaa

SEQ ID NO: 39406 - RNA, 1563 nt, Artificial Sequence
  derived and/or modified sequence opt11 from VP1__Norovirus_and/or_Norovirus-like__KT864685
augaaaauggcguccuccgacgcggcccccuccaaugacggcgccgccggccucguccccgaaggcaacaaugaaacacucccccuagaacccgucgccggcgcugcaauagccgcccccguaaccggccaaaacaacauaaucgaccccuggauccgaacgaacuucguccaagcccccaacggcgaauuuaccgucucaccccgcaacucucccggcgaaauacuacuaaaccuagaacuggguccugaccuuaaccccuaccucgcgcaccucucccgaauguacaacggauacgcuggcggugucgaaguacaaguccuccucgccggcaacgccuucacagccggcaaaauccucuucgccgccguuccaccuaacuuccccguagaauuucuaucccccgcacaaaucacaaugcucccacaccucauaguugacguccgaacccucgaaccuauaaugauaccacuacccgacguccgcaacaccuucuuccacuacucaaaccaacccaacucccgcaugcgccucgucgccaugcuauacacaccucuccgcucaaacggauccggagacgacgucuucaccguuucaugucgaguccucacccgcccaacccccgacuucgaauuuacauaccucguacccccaucagucgaaucaaaaaccaaaccauucucccucccuauccucacacucucagaacucacaaacucccgcuuccccgucccaauagacucccuauucacugcccaaaacaacguccuacaaguccaaugccaaaacggccgcugcacccucgacggcgaacuucaaggcaccacucaacuccuccccucuggaauaugcgcauuccgcggccgcgucaccgcccaaauaaaccaacgcgacagauggcacaugcaacuccaaaaccucaacggcacuacauacgaccccaccgaugacguccccgcaccccucggcacccccgacuucaaaggcgucgucuucggcauggucucccaacgcaacgucggaaacgaugccccaggcuccacccgagcucaacaagcaugggucucaacauacucuccccaauucguccccaaacucggccccgucaaccuccguaucucggacaacgacgacuuucaauuccagccaaccaaauucacccccgucggagucaacgacgacgacgauggacaucccuuccgucaaugggaacuccccaacuauucuggcgaacuaacacuaaauaugaaccuagcaccacccgucgcucccaacuuccccggcgaacaacuacucuucuuccgaucauuuguccccugcucuggcggauauaaccaaggcaucauagacugccucauaccacaagaauggauacaacacuucuaccaagaauccgcacccagccaaucagacgucgcacuaauacgcuacguaaacccagacaccggccgcacccuauucgaagccaaacuccaucgcucaggauauaucaccgucgcccacagcggcgacuauccacucguaguuccugccaacggccacuuccgcuucgacucaugguaa

SEQ ID NO: 39407 - RNA, 1563 nt, Artificial Sequence
  derived and/or modified sequence opt11 from VP1__Norovirus_and/or_Norovirus-like__KT864684
augaaaauggccucuucugacgccgcacccucuaacgacggcgccgcaggccucguaccagaaggcaacaacgaaacccuuccauuagaacccguugccggagccgccaucgcugcccccgucaccggccaaaacaacaucaucgacccauggauccgaacaaauuuuguccaagcacccaacggcgaauuuacaguuucaccacgaaacucccccggcgaaauucuacuaaaccucgaacucggacccgaccuaaaccccuaccuagcccacuuaucucgcauguacaacggcuacgccggcggcgucgaaguccaaguccuucucgcugguaacgccuucacugcaggcaagauccuauucgccgccguacccccaaauuuccccgucgaauuucucucuccagcccaaauaaccaugcuaccacaccucaucguagacguccgcacccucgaacccaucaugaucccacuccccgacguacgaaacaccuucuuccacuacucaaaccaacccaacagucgcaugcggcuagucgcuaugcuuuacaccccacuccgcuccaacggcuccggagaugacgucuucaccgucucaugucgcguccuuaccagaccaaccccagacuucgaguucaccuaccucgucccacccuccgucgaauccaaaacuaaacccuucucccuccccauccugacucucucagaacuuacaaacucccgauuccccguacccaucgacucccuuuucaccgcacaaaacaacguccuacaaguccaaugccaaaauggccgcugcacccucgacggcgaacuccaaggcaccacccaacuacuacccucuggcaucugcgccuuccgcggccgcgucaccgcccaaaucaaccagcgugaccgcuggcacaugcaacuucaaaaccugaacggcacuaccuacgaccccacagacgacguccccgcuccucucggcacucccgacuucaagggcguugucuucgguauggucucccaacgaaacguugguaacgaugcacccgguuccacccgagcccaacaagcaugggucucuaccuacuccccgcaauucguccccaaacuaggaagcgucaaccuacgcaucuccgacaacgacgauuuccaauuccaaccaaccaaauucaccccaguaggcgucaacgacgaugacgacggacaccccuuccgccaaugggaacucccaaacuacuccggagaacucacacucaacaugaaccuagccccaccaguagcacccaauuuccccggcgaacaacuccucuuuuuccgcucauuuguccccugcuccggaggcuacaaccaaggcaucaucgacugccucaucccacaagaauggauacaacacuucuaucaagaauccgcaccuucccaaucagauguugcacuaauacgcuacguaaaccccgacaccggccgaacccucuucgaagccaaacuccaccgcucaggcuacauaaccgucgcccacucuggagacuacccacucguaguaccugccaacggccacuuccgcuucgaauccugguaa

SEQ ID NO: 39408 - RNA, 1563 nt, Artificial Sequence
  derived and/or modified sequence opt11 from VP1__Norovirus_and/or_Norovirus-like__KX764836
augaaaauggcauccagcgacgcagcgcccuccaacgacggcgccgccggccucguccccgaaggcaacaacgaaacccucccauuagaacccguugccggggccgccauagcagcacccgucaccggccaaaacaauaucaucgaccccuggaucagaaccaacuucguccaggcuccuaacggagaauuuaccguuuccccacgaaacucccccggcgaaauccuccucaaccucgaacuaggaccagacuuaaaccccuaccucgcucaccucagccgcauguacaacggcuacgcaggcggagucgaaguacaaguccuacuagccggcaacgccuucaccgccggcaaaauccucuucgcagcaguaccacccaacuuccccguugaauuucucuccccagcacaaaucacaaugcucccgcaccucaucguugacguccgcacccucgaaccaauaaugauaccccucccagacguacgcaacaccuucuuccauuacucaaaccaacccaacucacgcaugcgucucgucgccaugcucuacacaccccuacgcuccaacggauccggcgacgacgucuucaccgucucaugccgcguacucacccgccccacaccggacuucgaauuuacuuaccuaguacccccuuccgucgaaagcaaaaccaaaccuuucucccucccgauccucacccuauccgaacucaccaacucucgcuuccccguccccaucgacucccucuucacagcccaaaauaaugucuuacaaguccaaugccaaaacggccgcugcacccucgauggugaacuacaaggcacaacccaacuccuccccuccggcaucugcgcauuccgaggccgaguaacagcacaaauaaaccaacgcgaccguuggcacaugcaacuccaaaaccuuaacggaacaaccuacgaccccaccgacgacguacccgcaccacuaggaacacccgacuucaaaggcgucgucuucggaauggucucccaaagaaacgucgguaaugacgcacccggauccacacgcgcacaacaggcaugggucucaaccuacucaccccaauucgucccuaaacucggcuccgucaaccucagaaucucugacaacgacgacuuccaguuccaacccaccaaauucacacccgucggcgucaacgacgacgacgacggccacccguuccgccaaugggaacuccccaacuacucaggcgaacucacacuaaacaugaaccuagcaccaccagucgcccccaacuucccaggcgaacagcuccucuucuuccgcuccuucguaccaugcagcggcggcuacaaccaaggcgucauagacugccucaucccccaagaauggauccaacacuucuaccaagaaucagcaccgagccaguccgacguagcacucauccgcuacgucaacccagacaccggacgaacccucuucgaagccaaacuacaccgcuccggcuacauaacagucgcacacagcggcgacuacccccuaguuguucccgccaacggccacuuccgcuucgaagccugguaa

SEQ ID NO: 39409 - RNA, 1563 nt, Artificial Sequence
  derived and/or modified sequence opt11 from VP1__Norovirus_and/or_Norovirus-like__KX764845
augaagauggcaucaucugacgccgcgcccuccaacgacggcgccgcaggccucguccccgaaggaaacaaugaaacccuaccacuagaacccguagccggagccgccaucgccgcaccagucaccggacaaaacaacaucaucgacccauggauacgcaccaacuucguccaagcaccuaacggcgaauuuacaguaucaccccgcaacucccccggcgaaauccuacucaaccuagaacucggccccgaccucaacccauaccucgcacaccucucccgaauguacaauggcuacgccggaggcgucgaaguacaaguccuccucgccggcaaugccuucacagcaggaaaaaucuuauucgcagccguaccgcccaacuuccccguggaauuucucucaccagcccaaaucaccaugcuaccucaccucauagucgacguccgcacacucgaacccaucaugauaccccucccugacguacgaaacaccuucuuccacuacuccaaucaacccaacucccgaaugcgccuagucgccaugcucuauacuccccuucgauccaacggguccggcgacgacgucuucaccgucucgugccguguccucacccgccccacacccgacuuugaguucaccuaccucgugccacccucagucgaaucuaaaaccaaacccuucucccuccccauccuaacccucagugaacuaaccaacucacgcuuccccguacccauagacucucuauuuacugcucaaaacaacguacuacaaguccaaugccaaaacggccgcugcacccucgacggagaacuccaaggaaccacacaacuacuccccuccggaaucugcgccuuccguggacgcgucaccgcacaaaucaaccaacgagaccgauggcauaugcaacuucaaaaccuaaacggcaccaccuaugaucccacagacgacguccccgcuccccucggcacccccgacuucaaaggaguuguuuucggcauggucucacaacgcaacguaggcaacgacgcccccggcucaacccgcgcccaacaagccugggucagcaccuacucccuucaauucguucccaaacucggcucagucaaccuccgaauaucugauaaugacgacuuccaauuccaacccacgaaauucacccccgucggcgucaacgacgaugaugacggacaccccuuucgccaaugggaacuccccaacuauuccggcgaacuaacccucaacaugaaccuagcacccccagucgcccccaauuuuccaggagaacaacuacuguucuuccgcuccuuuguuccuuguucugguggcuacaaccaaggaauuaucgacugccuaaucccccaagaauggauccaacauuucuaccaagaauccgcccccucccaaucugacguagccuuaauccguuacguaaaccccgacacaggccgcacacucuucgaagccaaacuccaccgcuccggauacaucaccgucgcccacuccggugauuauccccuagucguccccgccaacggccacuuccgcuucgaagccugguag

SEQ ID NO: 39410 - RNA, 1563 nt, Artificial Sequence
  derived and/or modified sequence opt11 from VP1__Norovirus_and/or_Norovirus-like__KX764837
augaaaauggccagcaacgacgccgcccccuccaaugacggagccgccggccuagucccagaaggcaacaaugaaacacuaccccucgaacccgucgccggcgccgcuaucgccgccccugucaccggccaaaacaauaucaucgaccccuggauccgcaccaacuucguacaagcccccaacggagaauuuaccgucucgccacgcaacucccccggcgaaauacuccuaaaccuggaacucggcccagaucucaaccccuaccuggcccaucuaucccgcauguacaacgguuacgcaggaggcgucgaaguccaaguccuccuugccggcaaugccuucaccgccggaaaaauccucuucgcugccgugcccccuaauuucccagucgaauuucuuuccccagcacaaaucacuaugcuuccucaccugaucgucgacguccgaacccucgaacccaucaugaucccccuccccgacguccgcaacaccuucuuccacuauuccaaccagccaaacucuagaaugcgacucgucgcgaugcuuuacacaccccuccggucaaacggaucaggcgacgacgucuucaccguauccugcagaguacuaacacgaccuaccccagacuucgaguucacauaccuugucccacccuccguagaaucaaaaaccaaaccauucucacuuccgauccucacccucuccgaacuaaccaacucacgcuuccccguaccaaucgacucacucuucacagcccaaaacaacguccuacaaguacagugccaaaacggacgauguacacucgacggcgaacuccaaggcgcgacacaacuccucccauccggcauaugcgccuuccgcggccgagucacagcacaaaucaaccaacgcgaccguuggcacaugcaacuccaaaaccucaacggcaccacauacgacccuacagacgacgucccagcaccccucggcaccccugauuucaaaggcguggucuucggaauggucucccaacgcaacguuggcaacgacguccccggcuccacccgcgcccaacaagccugggucuccacauacagcccccaauucguaccaaaacucggaucaguuaaccuccgcaucucagacaacgacgacuuucaauuccaaccaaccaaauucacaccagucggcgucaacgaugacgacgacggccaccccuuccgacagugggaacuacccaacuauucaggcgaacugacccuaaacaugaaccucgcacccccagucgcccccaacuuucccggcgaacagcuccuauucuuccgcucauucguucccugcucaggaggcuauaaccaaggaguaaucgacugccuuaucccccaagaauggauccaacacuucuaccaagaaucagccccaucucaauccgacgucgcccucauccgauacguaaaccccgacaccggccgcacccucuucgaggccaaacuacaccgcucuggguacaucaccgucgcccacucaggagacuacccacucgucguccccgccaauggccacuucagauucgacgccugguaa

SEQ ID NO: 39411 - RNA, 1563 nt, Artificial Sequence
  derived and/or modified sequence opt11 from VP1__Norovirus_and/or_Norovirus-like__KX764838
augaagauggcaucaaacgacgccgcgcccuccaacgacggcgcagccggccucguacccgaaggcaacaacgaaacacuuccccuagaacccguagcaggcgcagcaauagcagcccccgucaccggacaaaacaacaucaucgacccauggaucagaaccaauuucguccaggccccuaacggcgaguucaccgucucaccacgcaauagccccggcgaaauccuacucaaccuagaacucggccccgaccucucacccuaccuagcccaccuaucacgcauguacaacggcuacgcugguggaguagaaguccaaguccuucucgccggcaacgccuuuaccgccggcaaaauacuauucgccgccguucccccaaacuuccccgucgaguuccucucccccgcacaaaucaccaugcuaccccaccuaaucgucgacguccgcacccucgaacccaucaugauaccccuucccgauguccgcaacacuuucuuucacuacucuaaccaacccaacucacgcaugcgacucgucgccaugcuguauacaccccuccgcuccaacggauccggagaugaugucuucaccgucuccugucguguccucacccgccccacccccgacuucgaguucaccuaccuaguacccccaucugucgaauccaaaacaaaacccuucucccuacccauacucacccuguccgaacucacaaacucucgcuuccccguccccaucgacucacucuucacagcccagaacaacguccuacaaguccaaugccaaaacgggcgaugcacccuagacggcgaacuccaaggcaccacccaagucgucccgucgggcaucugcgccuuccgcggucgcguuaccgcacagaucaaccaacgcgaccgauggcacaugcaauuacaaaaccuaaacuccaccaccuacgaccccaccgacgauguccccgcaccccucggcacacccgacuucaaaggcgucgucuucggcauggucucacaaaggaacguaggcaacgaugccccaggauccacacgcgcacaacaagcaugggucucaaccuacucgccacaauucguccccaaacucggcucaguaaaccuccgcaucucagacaaugacgacuuccaauuccaacccacaaaauucaccccagucggcgucaacgacgacgacgacggccaccccuuccgccaaugggaacuccccaacuacagcggggaacucacccucaacaugaacuuagcuccacccgucgccccaaauuuucccggcgaacaacuccuuuucuuccgcuccuucguccccugcuccgggggauacaaccagggcaucaucgauugccuaaucccacaagaauggauucagcauuucuaccaagaauccgcgcccucccaauccgacgucgcccucauccgcuacgucaacccagacaccggucgcacacuuuucgaagcaaaacuccaccgcucuggcuacaucgcaguggcccacucuggagacuacccccuaguagucccugccaacggccacuuccgauucgacucuugguaa

SEQ ID NO: 39412 - RNA, 1563 nt, Artificial Sequence
  derived and/or modified sequence opt11 from VP1__Norovirus_and/or_Norovirus-like__KU687016
augaaaauggccagcaacgacgccgcccccuccaacgacggcgcagcuggucuaguacccgaagguaauaacgaaacccucccccuugaaccagucgccggagcugccauugccgcaccagucacgggccaaaacaacaucaucgaucccuggauccgcacaaacuucguccaagcccccaacggagaauuuaccguuucaccccgcaacucacccggagaaauccuacucaaccucgaacuaggccccgaccucaaccccuaccucgcccaccucucaagaauguacaacggauacgccggcggagucgaaguccaaguacuucucgcaggcaacgccuucaccgcuggaaaaauccucuucgcggccguuccacccaacuuccccgucgaguuccuaagccccgcacaaaucaccaugcuaccccaccuaauuguagacguccgaacccucgaacccaucaugaucccccuccccgacguccguaacaccuucuuucacuacucaaaccaacccaauucacgcaugcgccuagucgccaugcucuacacgccccuccgaucaaacggcagcggagacgauguuuucaccguauccuuccgaguccuaacccgacccacucccgacuucgaguucaccuaucuaguaccucccagcguagaaucccgcaccaaacccuucucucuccccauccucacacucagcgaacuaacaaacucccgauuccccguccccaucgacucccuauucaccgcccaaaauaacguccuacagguccaaugccagaacgggcgaugcacacuagacggagaacuccaaggcacuacccaacuacuccccagcggcaucugcgccuuucgcggccaaguaaccgcccaaaucaaccaacgcgaccgcuggcacaugcaacuacaaaaucucaacggcaccaccuacgacccaaccgacgacgucccugcuccacucggcacucccgacuucaaaggagucguauucggcauggucucacaacguaacguaggcaacgacgcuccaggcuccacccgugcccaacaagccugggucucuacauacuccccucaauucguaccuaaacucggcucuaucaaucuacgcaucagcgacaacgacgacuuccaauuccaacccaccaaauucacccccgucggcgucaaugacgacgacgauggccaccccuuccgccaaugggaacuucccaauuacuccggcgaacucacccucaacaugaaccucgcacccccuguagcaccgaauuuccccggcgaacaacuccucuucuuucgauccuucguacccugcagcggcggcuacaaccaaggaaucaucgacugccucaucccccaagaauggauccaacacuucuaccaggaauccgcccccucacaaucagacguugcacucaucagauacgucaaccccgauaccggccgcacccucuucgaagccaaacuacaccgcucaggcuacaucaccguagcccacuccggagacuacccccucguuguacccgccaacggccacuuccgcuucgaugcuugguga

SEQ ID NO: 39413 - RNA, 1563 nt, Artificial Sequence
  derived and/or modified sequence opt11 from VP1__Norovirus_and/or_Norovirus-like__KU687015
augaaaauggccuccucggacgccgcccccuccaacgacggcgccgccggccuaguccccgaaggaaacaacgaaacccucccccucgaaccaguagcaggagccgccauagccgcccccguaacaggacaaaacaacaucaucgaccccuggauccgaaccaacuucguccaagcccccaacggcgaauuuaccgucuccccucgcaacucacccggcgaaauccuacuaaaccucgaauuagguccugaccuuaaccccuaccucgcccaccucagccgaauguacaacggauacgcuggaggcguagaaguccaaguacuacucgcaggcaacgccuucaccgccggcaaaauacuuuucgcugccguccuacccaacuucccagucgaauuucuaucucccgcccaaaucacuaugcuaccacaccucauagucgacguccgcacucucgaaccaaucaugaucccccuccccgacguccguaacaccuucuuccacuacuccaaucagcccaauucccgaaugcgccuaguagccaugcucuauacaccccuccgauccaacggaucuggcgacgacgucuucaccguguccugccguguacucacccguccaaccccagacuucgaguucaccuaccuuguacccccuucugucgaauccaaaaccaaacccuucucucuuccaauacugacacuauccgaacucaccaacucccgauucccgguccccaucgacccccuauucaccgcccaaaacaacgucuugcaaguccaaugccaaaacggccgaugcacccuagauggagaacuccaaggcaccacccaacuucuucccagcggaauuugugccuuccgcggccgcgucaccgcccaaaucaaccaaagagaccgauggcacauccaacuccagaaccuuaacggaaccaccuacgauccaaccgacgacgucccagcaccccucggaaccccagacuucaaaggcgucguauucggcauggucucccagcgcaacgucgggaacgacgcccccgguuccacacgugcccaacaagcauggguauccaccuacagcccccaauuugucccuaaacucggcuccauaaaccuccgcaucuccgacaacgacgacuuccaauuccaacccacuaaauuuaccccagucggagucaacgacgacgacgacggccaccccuuccgccaaugggaacuccccaacuacuccggcgaacucacccucaacaugaaccucgccccacccgucgcacccaacuuccccggcgaacaacuccucuucuuucgcuccuucguucccugcuccggcggcuacaaucagggcauaaucgacugccucaucccccaagaauggauacaacauuucuaucaagaauccgcccccucccaauccgaugucgcccucauucgauacgucaaccccgauaccggccgcacccuuuucgaagccaaacuccaccgauccggcuacaucaccgucgcccacucaggcgacuacccccugguagucccagccaacggacacuuucgauucgacgccugguaa

SEQ ID NO: 39414 - RNA, 1563 nt, Artificial Sequence
  derived and/or modified sequence opt11 from VP1__Norovirus_and/or_Norovirus-like__KU687013
augaagauggcguccuccgacgcugcacccuccaaugacggcgcggcaggccucguccccgaagguaacaacgaaacucuaccccuagaacccguagcaggcgccgccaucgccgcccccgucaccggccaaaacaacauaauagacccauggauccgcaccaacuucguacaagcccccaacggagaauuuaccguaucaccacgaaauucccccggcgaaauucuccucaaucuagaacucggccccgaucuaaaccccuaccuagcccaccucucacgcauguacaauggcuacgcaggcggcgucgaaguccaaguccuucuagcaggcaacgccuucacagcaggcaaaauccucuucgccgcaguacccccaaacuuccccgucgaguuccucagcccugcccaaaucaccaugcuuccucaccucauagucgacguccgaacccuugaacccaucaugaucccccuaccagacguacgcaacaccuucuuccauuacuccaaccaacccaacucgcgcaugagacucguagcaaugcucuacacuccccuucgcuccaacggcuccggcggcgacgucuucaccgucagcugcagaguccucacccgcccaaccccugacuucgaguucaccuaccuagucccgcccuccguuaaauccaaaaccaaacccuucucccuaccuauccucacccuuuccgaacucaccaacagccgauucccaguccccaucgacucacucuucaccgcccaaaacaacguucuacaaguccaaugccaaaacggacgcuguacccucgacggcgaacuacaaggcacaacccaacuacucccauccggcaucugcgcauuccguggacgagucacagcccaaaucaaccaacgcgaccgauggcacaugcaacuccaaaaucuuaacggaacaaccuacgacccaaccgacgacguacccgcuccccugggcaccccagacuucaaagggguaguauucggcauggucucccaacguaacgucggcaacgacgccccaggcagcaccagagcccaacaagccugggucucaaccuacucaccccaauucguacccaaacucggcuccaucaaccuccguauauccgacaacgacgauuuccaauuccaacccacaaaauucacacccguaggugucaaugacgacgacgacggacacccauuuagacaaugggaacuccccaacuacagcggcgaacuuacccucaacaugaaucucgccccaccugucgcccccaacuuccccggcgaacaacuccuuuucuucagguccuucguccccugcucaggcggcuauaaccagggaauaaucgacugccuaauaccccaagaauggauccaacacuucuaccaagaauccgcccccucccaauccgacguugcccuaauccgcuacgucaaccccgacaccggccgaacacucuucgaagccaaacuacaucgcucaggcuacauaacugucgcccacucaggagacuacccccucguaguacccgccaacggccacuuccgcuuugaauccugguaa

SEQ ID NO: 39415 - RNA, 1563 nt, Artificial Sequence
  derived and/or modified sequence opt11 from VP1__Norovirus_and/or_Norovirus-like__KX764839
augaaaauggccuccucggacgcugcccccuccaacgacggcgcagcaggucucgucccugaaggaaacaaugaaacccucccccucgaacccguagccggcaccgcuauagcggcccccgucacaggacaaaacaauaucaucgaccccuggauccgcaccaacuucguccaagcccccaacggcgaauuuaccgucagcccacgaaacucaccuggagaaauccuccucaaucucgaacuaggaccagaccuaaacccauaccucgcacaccuauccagaauguacaacggauacgccggcggugucgaaguccaaguccuccuagccggaaaugccuucaccgccggcaagauccuuuucgccgcugucccacccaauuuccccgucgaguuccuguccccagcucaaauaaccaugcucccccacuuaaucgucgacguccgcacacucggcccaauaaugaucccacugcccgacguccggaacaccuucuuccacuacuccaaccaacccaacucccgcaugcgccuagucgccauguuauacacgccccucagauccaacggcucaggagacgacguauucaccgucuccugucguguccuaacccgccccaccccagacuucgaguucacauaccucgucccacccuccgucgaaucaaaaaccaaaccuuucucccuccccauccuuacccuuagcgaacucaccaacucucgcuuccccguacccaucgauucccucuucaccgcccaaaacaacguacuucaaguccaaugccaaaacggcagauguacacuggacggcgaacuccaaggcaccacucaacuccuaccaucaggcaucugcgcauuccgcggucgcgucaccgcccaaauaaaccaacgagaccgauggcacaugcaacuccaaaaccucaacggcacgaccuacgacccaacugacgacguaccagcgccccucggcacuccugacuucaaaggcgucgucuucggaauggucucccaacgcaacguaggcaacgacgccccaggcagcacacgcgcccaacaagccugggucuccaccuacucaccucaauucguaccuaaacucggauccgucaaccuccgcaucuccgacaacgacgacuuccaauuccagcccacaaaauucaccccuguaggaguaaaugacgacgacgacggccaucccuucagacaaugggaacuccccaacuacuccggcgaacuaacccuaaauaugaaccucgccccacccguagcccccaacuuccccggcgaacaacuauuauucuuccgcuccuucgucccaugcuccggcggcuacaaccaaggcauaaucgacugccuaaucccacaagaauggauacaacauuucuaccaagaauccgccccaucacaaucggacguagcccuaauccgcuaugucaacccagacaccggacgcacccuauucgaagccaaacuccaucgcucuggauacaucacagucgcacacuccggcgacuacccgcucgucguaccagcaaacggccauuuccgcuucgaagcaugguaa

SEQ ID NO: 39416 - RNA, 1563 nt, Artificial Sequence
  derived and/or modified sequence opt11 from VP1__Norovirus_and/or_Norovirus-like__KX764844
augaaaauggcauccaacgacgccgcccccucuaacgacggagccgccggccucguaccagaaggcaacaacggcacccucccccucgaacccguugccggagcagcuaucgccgcccccgucacuggucaaaacaacaucauugaccccuggauaagaauaaacuuuguccaagcaccaaacggcgaauuuaccgucucaccacgaaacucacccggcgaaauccuacucaaccucgaacuaggcccagaccucaacccauaccucgcccaccucucucgcauguacaacggauacgccggcgguguugaaguacaagugcuucucgcaggcaacgccuucaccgccggcaagauccucuucgccgcugucccacccaacuuccccguagaauuucuaucucccgcccaaaucacaaugcucccccaccuaaucgucgacguccguacccucgaaccuauuaugaucccccugcccgacguccgaaacacuuucuuccacuacuccaaccaacccaacucccgcaugggccucgucgcuaugcucuacacaccacuacgcucuaacggaucaggcgacgacgucuucaccgucuccugccgcguacucacccgacccacccccgacuucgaauuuaccuaucucgucccacccuccguagaaucuaaaaccaaacccuucucccucccaaucuuaacacuauccgaacucaccaauucccgcuuccccguacccaucgacucucucuuuaccgcccaaaacaacguucuccaaguccagugccaaaacggacgcugcacacucgacggcgaacuccaagguaccacacaacuacucccauccggcauaugcgccuuucgaggccgagucacagcucaaaucaaccaacgcgaccgauggcacaugcaacuccaaaaccuuaacggcaccacauacgaccccaccgacgacguaccagcaccccucggaacucccgacuucaagggcguagucuucggaauggucucccaacgaaacguaggcaacgacgcccccggaucaacccgagcccaacaagcaugggucuccaccuacagcccccaauucguccccaaauuaggcuccguaaaucuccgcaucuccgacaacgacgacuuccaauuccaacccaccaaguucaccccggucggcguaaacgacgacgacgacggccacccauuccgacaaugggaacuccccaacuacuccggcgaacuaacccuuaacaugaaccucgccccacccgucgcccccaauuuccccggugaacaacucuuauucuuuagauccuucguucccugcuccggcggcuauaaccaaggcaucaucgacugccucauaccccaagaauggauacagcacuucuaccaagaauccgcccccucacaaagcgacgucgcccucauccguuacgucaaccccgacaccggacguacccucuucgaagccaaacuccaccgcaguggcuacauaaccguagcccacuccggcgacuacccccucguggucccugccaacggccacuuccguuucgaauccugguaa

SEQ ID NO: 39417 - RNA, 1563 nt, Artificial Sequence
  derived and/or modified sequence opt11 from VP1__Norovirus_and/or_Norovirus-like__KT864686
augaagauggccuccuccgacgccgcaccauccaacgauggagccgccggccuaguccccgaaggaaacaacgaaacucucccccucgaacccguugucggggccgcaaucgccgcccccguuaccggccaaaacaacaucaucgacccauggauccguacaaacuucguccaagcacccaacggcgaauuuaccguaucgccacgcaacuccccuggcgaaauccuccucaaccucgaacuaggacccgaccucaauccauaccucgcccaccucucccgcauguacaacggcuacgccggcggaguagaaguccaaguacuacuagccggcaacgccuucaccgcuggcaagauccucuucgcagccguaccacccaacuuccccgucgaauuucuaucucccgcacaaauaaccaugcuaccacaccuuaucguagacguccgcacucuagaacccaucaugaucccccugccagacguucgcaacaccuucuuccacuacuccaaccaacccaacucacgcaugcgccugguagccaugcucuacacaccccuccgauccgacggcucuggagaugacguauucacagucuccugcagaguccugacccgaccuacccccgacuucgaguucaccuaccuaguuccucccuccgucgaaucaaaaacaaaacccuucuccuuacccauccuaacacucucagaacuaaccaacagccgcuucccugucccaaucgacucucucuucacugcucaaaacaacguccuucaaguccaaugccagaacggccggugcacacucgacggagaacuccaaggcaccacucaacuucuccccuccggaaucugcgccuucagaggucgcgucacagcccaaauuaaccaaagagaccgcuggcacaugcaacuacaaaaccuaaacggaacaacauacgaccccaccgacgacgucccagccccacucggcacaccugacuucaaaggcguaguauucggcauggucucccagcgcaacgucggcaacgacgcccccggcucaacucgcgcccaacaagccugggucucuacauacagcccacaauucgucccuaaacucggcucagucaaccuccgcauaucagacaaugacgacuuccaauuccaacccacgaaauucacucccgucggagucaacgacgacgacgacggccacccauuccgccaaugggaacuucccaacuacuccggcgaacuuacccucaacaugaaccuagcaccacccgucgcccccaacuuccccggcggccaacuacuauucuuccgauccuucguccccugcuccggcggauacaaccaaggcaucaucgacugccucaucccccaagaauggauacaacacuucuaccaggaauccgccccaucccaauccgacguagcccuaauacgcuacguaaaccccgacacaggccggacccucuucgaagcaaaacuucaccgcuccggcuacauaaccguagcccacuccggcgauuauccacucgucguaccggccaauggccacuuccgcuucgaaucaugguaa

SEQ ID NO: 39418 - RNA, 1563 nt, Artificial Sequence
  derived and/or modified sequence opt11 from VP1__Norovirus_and/or_Norovirus-like__KU687012
augaaaauggccuccuccgacgccgcacccucuaacgacggcgcagccggccuuguccccgaaaucaacaccgaaacccucccccuagaacccguugccggcgcagcgauugcugcccccgucaccggccaaaacaacaucaucgaccccuggauacgaaacaacuucguccaggcacccaacggugaauuuaccgucucaccaagaaacucacccggagaaauccucaugaaucucgaacucggccccgaccucaaccccuaccuugcccaccuaucacgcauguacaauggcuacgccggaggugucgaaguccaaguccuccuagccggaaacgccuucaccgccggcaaaauacucuucgccgccgucccaccaaauuucccagucgacaugcuuuccccagcccaaaucacaaugcucccucaccuaaccgucgacguacgcacccuugaacccauaaugauaccccuccccgacguccgaaaugucuucuaccacuucaacaaccaacccgcccccagaaugcgacucguugccaugcuauacacaccccuccgcucuaacggcucaggugacgacguuuucaccgucuccugucgcguacucacccgaccaaccccagacuuugaauuuaccuaccucgucccacccuccguggaaucaaaaaccaaacccuucacccuccccauccuaaccauaggagaacucaccaacucucgauuccccgcacccaucgaccaacucuacacaucccccaacaccgacauccuaguccagccucaaaacggccgcugcacccuugacggcgaacuccaaggaacaacucaacuccucaccaccgccaucugcucuuaccgcgguaccacauccaaccccacauccgacuacugggacgaucaccuucuccaccucguccaccccaacggcgccacauacgaccccaccgaagacguucccgcacccuucggaacccaggacuuccgaggcauccuuuacgguguccucacacaaaacacccaaucccccagagacgaagucucaaacucacgcggcaucuacaucuccucaacuucagauaaauuuaccccaaaacucggcacaauuggccuccaccaaguccaaggcgacaccgcuucaaaccaacaauccaaauucaccccaguuggaaucgccgugaaucaaaacacacccuuuaaacaaugggaacuacccaauuacucaggagcacucacccucaacacaaaucucgcaccagccgucggccccaacuuccccggcgaacaaauccucuucuuccgcucaaacguaccuagcguccaaggcacccacccaacccaggaaaucgacugccucaucccccaagaauggaucucucacuucuaccaagaauccgcccccucccaauccgacgucgcacugguacgcuacgucaaccccgacaccggccgcacaaucuucgaagccaaacuucacaggcaagguuucaucaccauugccgccacaggcucaaaccccgucgucgucccucccaacggcuacuuccgcuucgacuccugguaa

SEQ ID NO: 39419 - RNA, 1563 nt, Artificial Sequence
  derived and/or modified sequence opt11 from VP1__Norovirus_and/or_Norovirus-like__KU687018
augaagauggccuccaacgacgccgcccccuccaacgauggagccgccggucucguccccgaaaucaacaccgaaacacucccacucgaaccaguagcaggcgccgccauugccgcacccguaaccggccaaaauaacaucauagaccccuggauccgcaacaacuucguacaagcccccaacggugaauuuaccgucagcccccgcaacuccccaggagaaaucuuaaugaaccuagagcuuggacccgaccucaaccccuaccucgcacaccucuccagaauguacaacggcuacgcccgagguguagaaguccaaguccuccucgccggcaacgcauucacagccggcaaaauccuauucgccgccgucccaccaaacuuccccgucgacaugcucucccccgcccaaauaacaaugcucccccaccucaucgucgacguacgcacccuagaacccauaaugaucccacuaccagacguacgcaacgucuucuaucacuucaacaaccaacccgcacccagaaugagacucgucgcaauguuauacacuccccuucgaucuaacggcuccggcgacgacgucuuuaccgucuccugccgaguacuaaccagaccuacaccagacuucgaguucaccuaccuagucccacccuccgucgaauccaaaaccaaacccuuuacccuccccauccucaccaucggcgaacuaaccaacucccgcuuccccgccccgauagaccaacucuacaccucaccaaacgccgauguaguaguccaaccccagaacggccgcuguacccucgauggcgaacuucaaggaaccacccaacuccuaaccaccgccauaugcuccuaccgcggaacaacuuccaaccccaccucagauuacugggaugaccaccuccugcaccucguccacccuaacggcgcuaccuacgaccccaccgaagacgucccagcucccuucggaacccaagacuuccgaggcauccucuauggcguccuaacccagaacacccaaaauccccgcgacgaagucuccaacucacgcggaauauauauauccuccaccucagacaaauucacccccaaacucggaaccaucggccuccaccaaguacaaggagauacugcauccaaccagcaaucuaaauucaccccugucggcauagccgucaaccaaaauaccccauucaaacaaugggaacuaccgaacuacuccggcgcccucacacuaaacacaaaccuagcccccgccgucggcccaaacuucccaggagaacaaauucucuuuuuccgcucaaauguacccuccguccaaggcaaccacccuacacaagaaaucgauugccuaaucccccaagaaugggucagccacuucuaccaggaaucagcccccucccaaagcgacgucgcccucguacguuacgucaaccccgacaccggacgcacaaucuucgaagccaaacuccacagacaaggcuucaucaccauagccgcuacaggcuccaaccccgucgucgucccacccaauggcuauuuccgauucgaaaguugguaa

SEQ ID NO: 39420 - RNA, 1563 nt, Artificial Sequence
  derived and/or modified sequence opt11 from VP1__Norovirus_and/or_Norovirus-like__KU687021
augaaaauggccuccaacgacgccaccccauccaacgacggcgccgccggccugguccccgaaaucaacaccgaaacacucccccuagaacccgucgccggagcugcaaucgccgccccagucacuggccagaacaacaucaucgaccccuggauccgaaacaacuucguccaagcaccaaacggagaguucaccguaagcccccgaaacagcccaggcgaaauccucaugaaccuagaacucggcccagaccuaaaccccuaccuugcacaccuaucccgcauguacaacggcuacgcaggcggaguagaaguccaaguauugcucgccggcaacgccuucaccgccggaaaaauccuguucgccgccgucccacccaacuuccccguagacaugcuaagccccgcccaaaucaccaugcuuccccaccucauugucgacguccguacacucgaacccaucaugaucccccucccagacguccgcaacgucuucuaccacuucaacaaccaaccagcccccagaaugcgacucgucgccaugcucuacacaccgcugcgcucuaacgguucuggcgacgaugucuucaccgucucaugucgcguccucacccgcccaacccccgacuucgaguucacauaccuuguacccccauccgucgaauccaaaaccaaaccauucacucuccccauccuaacaauaggagaacuaaccaacucacgauuccccgcaccuauagaccaacuauauaccucacccaacgccgacgucgucguccaaccccaaaacggacgcugcacccucgacggagaacuacagggcaccacccaacuacucaccaccgcaauaugcuccuaccgcggcacuaccuccaacccgacaucagacuacugggacgaucaucuacuccaccucguccacccaaauggcgccaccuacgaccccacagaagacgucccagccccuuucggcacacaagacuucagagguauccucuacgguguccucacacaaaacacacaaaacccccgcgacaaagucuccaacucccgaggcaucuacauauccucgaccucagauaaauucacacccaaacuaggcacaaucggccuccaccaaguacaaggugacacagcaucaaaccagcaauccaaauucaccccagucggcaucgcagucaaccaaaauacaccuuucaaacaaugggagcugccaaacuacucaggcgcccucacccuuaacacuaaccuugccccagcugucggucccaacuucccgggcgaacaaauacucuuuuuccgauccaacguacccuccguccaaggcaaccaucccacccaagagauagacugccuaaucccacaagaauggguaucccacuuuuaccaagaaucagcucccucccaaagcgacgucgcacuggucagauacgucaacccggacaccggccgcacaaucuucgaggcaaaacuucaccgccaaggcuucaucauuauagccgccacaggcucaaacccugucguagugcccccaaacggcuacuuccgauucgaaagcugguga

SEQ ID NO: 39421 - RNA, 1563 nt, Artificial Sequence
  derived and/or modified sequence opt11 from VP1__Norovirus_and/or_Norovirus-like__KU687020
augaaaauggccucaucagacgccgcccccucuaacgacggcgccgccggccucguucccgaaauaaacaccgaaacacuaccucucgaacccguagcaggcgccgcaaucgccgcccccguaacaggacaaaacaacaucauugacccauggauccgcaacaacuucguccaagcccccaacggagaguucaccgucucaccacgaaacucacccggcgaaauacucaugaaccucgaacucggacccgaccucaacccauaucucgcacaccucucccgcauguacaacggcuacgccgguggcgucgaaguccaaguccuccucgccggaaaugccuucaccgccggcaaaauucucuucgcagccgucccucccaacuuucccguugacaugcuaucccccgcccaaauaacaaugcucccccaccucaucgucgacguacgaacucuugaacccaucaugaucccccucccagauguacgcaaugucuucuaccacuucaacaaccaaccagcccccagaaugcgacucgucgccaugcucuacaccccacuuagauccaacggauccggagacgacguauucaccgucagcugccggguccuuacccgacccacccccgacuucgaguucacauaccuaguuccacccucagucgaauccaaaacaaaaccguucacacuacccauccucaccauaggagaacucaccaacucccgcuuccccgcucccaucgaccaacucuacgcauccccaaacgccgacgucguaguucaaccacaaaacggccgaugcacccucgacggcgaacuccaaggaaccacccagcuccucaccacagcaauaugcuccuaccgcggcaccacauccaaucccacaucagacuacugggacgaccacuuacuacacuuaguccaccccaacggcgccaccuacgaucccaccgaagacgucccagcccccuucggcacccaagauuuccguggcauccucuacggcguacucacccaaaauacccaaaacccacgcgacgaaguaaguaacucccgcggaaucuacaucuccagcaccuccgacaaauucacacccaaacucgggaccaucggucuccaccaaguccaaggugacacagccucuaaccaacaauccaaauucacccccgucggcauagccguaaaucaaaacacacccuucaaacaaugggaauuaccaaacuacucaggcgcacucacucucaacaccaaccucgccccagccguaggcccaaacuuccccggcgaacaaauccuauucuuccgcucaaacgucccuuccguccaaggcaaccacccaacccaagaaaucgacugccucaucccccaagaaugggucucacacuucuaccaagaaucagcacccucccaaucugacgucgcacucguacgauacguaaauccagacaccggacggacuauauucgaagcaaaacuccaccgccaaggcuucauaaccaucgccgccaccggcucuaacccagucguagucccaccaaacggcuacuuucgcuucgacgcgugguaa

SEQ ID NO: 39422 - RNA, 1563 nt, Artificial Sequence
  derived and/or modified sequence opt11 from VP1__Norovirus_and/or_Norovirus-like__KU687014
augaaaauggccucaaacgacgccgcccccucuaacgacggagcugcaggacucguccccgaaaucaauacagaaacacucccccucgagcccgucgccggugccgccaucgcagcucccguaaccggccaaaacaacaucauagaccccuggauccgcaacaacuucguucaagcccccaacggcgaguucacagucucaccucgaaacuccccaggagaaauccuaaugaaccucgaacucggccccgaucuuaaccccuacuuagcccaccucucccgcauguacaacggauacgccggaggcguagaaguccaaguccuccuugcaggaaaugccuucaccgcaggaaaaauacucuucgcagccgucccacccaacuuccccgucgacaugcucauacccgcccaaaucaccaugcuuccccaccucauaguggacguucgcacccuagaaccuaucaugaucccacuccccgacgugcgcaacguauucuaccacuucaacaaccaacccgcgccccgcaugcgccuagucgccaugcucuacacaccccucagguccaacggauccggcgacgacgucuucaccgucucuugccgcguccuaacccgaccuacgccagacuucgaauuuacuuaucuagucccacccuccgucgaauccaaaacuaaacccuucacccuacccauucucacaaucggcgaacuaacaaacucacguuuccccgcccccaucgaccaacuguacaccucacccaaugccgacgucgucguccaaccucaaaacggacgaugcacccucgacggugaauuacaaggaacaacccaacuccucaccacagccaucugcucauaucgcggcaccacguccaaccccaccuccgacuacugggacgaccaccuccuccaccucguccaccccaacggcgccaccuacggcccaacagaagacguccccgcgcccuucggaacccaagacuuucggggaauacucuacggcguccuaacccaaaacacccagaauccccgagacgaaguauccaacucccgcgguaucuacaucuccuccaccucagacaaauucacucccaagcucggaaccaucggccuacaucaaguccagggggacacugccuccaaucaacaauccaaauucacccccguaggcaucgccgucaaccaaaacacacccuucaaacaaugggaacucccaaacuacuccggcgcccuuacccuaaacaccaaccucgccccagccgucggucccaacuuccccggcgaacaaauccucuuuuuccgaucaaacgucccuuccguccagggcacccauccuacccaagaaauugauugccuuaucccccaagaauggaucucucacuucuaccaagaaucggcaccaucccaauccgacgucgcccucguacguuacguuaacccagacaccggccguaccaucuucgaagccaaacuucaccgccaagguuucauaacuaucgccgcaacaggauccaauccagucgucguacccccaaacggcuacuuccgguucgacgccugguga

SEQ ID NO: 39423 - RNA, 1563 nt, Artificial Sequence
  derived and/or modified sequence opt11 from VP1__Norovirus_and/or_Norovirus-like__KU687019
augaaaauggccucaaacgacgccgcacccuccaacgacggugccgccggccucguucccgaaaucaauacagaaacacucccccuagaacccgucgccggcgccgccaucgcugccccagucacagggcaaaacaacauaaucgacccuuggauccgaaacaacuuuguacaagcccccaacggcgaauuuaccguuucaccccguaauuccccaggcgaaauccuaaugaaccucgaacucggcccagaccuaaaccccuaccucgcccaccucucccguauguacaacggauaugccggcggcgucgaaguccaaguccuccucgccggcaacgccuucaccgcuggaaaaauccucuucgccgcuguuccacccaauuuccccguagacaugcuaucccccgcccagaucaccaugcuaccacaucuaaucgucgacguacgaacccucgaacccaucaugauaccacuaccagacguccgcaacgucuucuaccacuucaacaaccaacccgccccacgcaugcgacuugucgcaaugcucuacacaccccuacgcucaaacggaucaggcgacgacgucuucaccgucucaugccgaguacuaaccagacccacaccagacuucgaguucaccuaccugguacccccuuccgucgaauccaaaaccaagcccuccacccuacccauccucaccaucggcgaacucacuaacucacgauuccccgcaccaaucgaccaacucuacaccucucccaacgccgaugucgucguacaaccccaaaacggccgcugcacccucgacggagaacuacaaggcaccacacaacuacucaccaccgccaucugcucauaccgaggcaccacaucuaaccccaccuccgacuacugggacgaccaccuccuccaccucgugcaccccaacggcgcaacuuacgauccuaccgaagacgucccagcccccuucggaacccaggacuuccgcggaauccuauacggcguccucacccaaaacacccaaaacccacgagacgaagucuccaacucucgcggcaucuacaucuccuccaccuccgacaaauucacccccaaacuaggcaccauaggacuacaccaaguacaaggcgauaccgccuccaaucaacaauccaaauucacccccguuggcaucgcagucaaccaaaacacaccuuucaaacaaugggaacuccccaacuacucaggcgcacuaacacucaacacagaucucgcacccgccguaggccccaauuucccaggcgaacaaauacuauucuuccgcucaaacguccccuccguccaaggcaaccaccccacgcaggaaauugacugccucaucccacaggaauggguuucacacuucuaccaagaaucagccccaucccaaucggacgucgcacucguccgcuacgucaacccagacaccggacgcacuauuuucgaagccaaauuacaccgacaaggauuuacaacgaucgcagccaccggcuccaaccccguuguagucccacccaacggcuacuuccgcuucgaaagcugguaa

SEQ ID NO: 39424 - RNA, 1563 nt, Artificial Sequence
  derived and/or modified sequence opt11 from VP1__Norovirus_and/or_Norovirus-like__KU687017
augaagauggcauccuccgacgccgcucccucuaacgacggcgccgcaggcuuaguucccgaaaucaacacagaaaccuuaccccucgaacccgucgccggagccgccaucgccgcccccguaaccggacaaaacaacaucaucgacccuuggauccgcaacaacuucguccaagcccccaauggagaauuuacagucucccccagaaacucccccggcgaaauccucaugaaccucgaacuaggacccgaucucaaucccuaccucgcucaccuuuccagaauguacaacggcuacgccggcggcguagaaguccaaguacuacuagccggcaacgccuucaccgccgguaaaaucuuauucgcagccgucccaccaaauuuccccguagacaugcuuucccccgcacaaauaaccaugcuaccccaccuaaucguagacguccgaacccucgaacccaucaugaucccacucccagacguacgaaacgucuucuaccauuucaacaaccaacccgcaccccgcaugcgccucgucgccguccucuacacuccccuccguucaaacggauccggcgacgacguauucaccgucuccugccgcguccucacccgccccacccccgauuucgaguucacauaccucgucccacccuccguagaaucaaaaaccaaaccauucacccuccccauacuaaccaucggcgaacucaccaacucuagauuccccgcccccaucgaccaacucuacacauccccaaacgcggacgucgucguacaaccccaaaacggccgcugcacccuggacggcgaacuacaaggcacaacccaacuucucaccaccgccaucugcucauaucgaggcacuaccuccaaucccacaucagacuacugggacgaucaccuccuacaccucguucacccaaacggcgccaccuacgaccccaccgaagacguacccgcaccauucggcacacaagacuuucgcggaauccucuacggcguacucacacaggacacccaaaaccccagagacgaaguaagcaacucacgcggcaucuacaucucauccaccuccgacaaauucacccccaaacuaggcaccaucggccuacaccagguacaaggugauacagcguccaaccaacaaucuaaauucaccccugucggcaucgccgucaaccaaaacaccccuuuuaagcaaugggaacuacccaacuacuccggcgcgcuaacccuaaacaccaaccucgcuccagccgucggacccaacuuccccggcgaacaaauccuauucuuccgcuccaacgucccauccguccaaggcaaccacccuacccaagaaauugacugccucaucccacaagaauggguaucacauuucuaccaagaauccgccccaucucaaucugacguagcacucguacgcuaugucaacccagacgccggacgaacaaucuucgaagcaaaacuccaucgccaaggcuucauaaccaucgccgcuaccggcuccaaccccgucgucgucccacccaacggcuacuuuagauuugaagccugguaa

SEQ ID NO: 39425 - RNA, 1563 nt, Artificial Sequence
  derived and/or modified sequence opt11 from VP1__Norovirus_and/or_Norovirus-like__KU687024
augaaaauggccucauccgacgcagcccccucaaacgauggugccgcaggccuaguccccgaaauaaauaccgaaacacuaccccucgaacccgucgccggagccgcaauagccgcucccgucaccggccaaaacaacaucaucgaccccuggauccgcaacaacuucguacaagccccaaauggcgaauccaccgucucaccccgcaacuccccaggcgagauccuaaugaaccuggaacuaggacccgaccugaaccccuaccuagcacaccucucccgaauguacaacggcuacgccgguggcgucgaaguccaaguccuacucgccggcaacgcauucaccgccggaaaaauacuauucgccgcaguacccccaaacuucccugucgacaugcuaucccccgcccaaaucacuaugcucccacaccucaucgucgauguacgaacacucgaacccaucaugaucccacucccggacgucagaaacgucuucuaccacuucaacaaccaacccgcaccccgaaugcgccucgucgccaugcucuacacuccccuucgcuccaacggugccggcgacgacgucuucaccguaagcugccgcguacucacacgcccgacccccgacuucgaguucacuuaccuaguaccacccuccgucgaaucaaaaaccaagccauucacccuaccaauccuaaccaucggugaacuaaccaacucccgcuucccagcgcccauagaucaacuuuacacuucacccaauaccgacauccucguacaaccccaaaacggacgcugcacccucgacggagaacuccaaggcaccacccaacuucuuaccaccgcuaucugcuccuaccgaggaaccacaucaaaccccaccucagacuacugggacgaccaccuccuacaccuaguccacccaaauggcgccacauacgaucccacugaagacguacccgcccccuucggcacccaagacuucagaggcauccucuacggcguccucacccagaacacacagaaccccagagacgaagucucaaauucccgcggaauauacaucuccuccaccuccgacaaauuuacacccaaacuagguaccauaggacuacaucaaguccaaggcgacacggccucaaaccaacagagcaaauucacacccgucggcaucgccgucaaccagaacacacccuuuaaacaaugggaacuacccaauuacuccggcgcccuaacccuaaacaccaaccucgcccccgccgucggcccaaacuuccccggcgaacaaauccuauucuuucgauccaacguacccucuguccagggcacccaccccacccaggaaaucgacugccucaucccacaagaauggaucucccacuuuuaccaagaauccgcccccucacaauccgacguagcucuaguccgcuacgucaaccccgacaccggccgcaccauauucgaagcaaagcuccaucgccaaggauucauuacaauugcagcaaccggauccaacccgguaguaguaccacccaacggcuacuuucgauuugaagccugguaa

SEQ ID NO: 39426 - RNA, 1563 nt, Artificial Sequence
  derived and/or modified sequence opt11 from VP1__Norovirus_and/or_Norovirus-like__KU687022
augaaaauggccagcaaugacgccgccccauccaacgacggagccgccggccuagucccagaaaucaacaccgaaacucucccccucgaaccagucgccggcgccgccauugccgccccaguuaccggccaaaauaacaucaucgacccauggauacgaaacaacuucguccaagcccccaacggcgaauuuacagucuccccacgaaacucgccgggcgaaauccucaugaaucuagaacucggaccagaccucaacccuuaccucgcccacccuagccgcauguacaacggcuacgcaggaggcgucgaaguccaaguacuacucgccggaaacgccuuuaccgcaggaaaaauacucuucgccgcaguuccacccaacuuccccguagacaugcuuucccccacccaaaucaccaugcuaccacaccuaaccgucgacguccgcacccucgaaccaauuaugaucccacuccccgacguccgcaacguauuuuaccacuucaacaaucaacccgcaccccgaaugcgccuagucgccaugcucuacacaccacuacgcuccaacggcuccggcgacgacguccucacagucuccugccgcguccucacccgccccacacccgacuucgaguucaccuaccucguaccacccagcguagaauccaaaacgaaacccuucacgcucccaauacucacaaucggagaacucacaaacucacgcuuccccgccccaaucgaccaacuauacaccagccccaacgccgacgucgucguccaaccccaaaacggacgcugcacacucgacggagaauuacaaggcacgacccaacuccucaccaccgccaucugcucuuaccguggcaccaccucuaaccccaccucugacuacugggaugaccaucugcugcaccuaguacaccccaacggagcuaccuacgaccccaccgaagacguaccugcuccauucggaacccaagauuuccgcgggauucuguacggcguccucacccaaaacacccaaaacccccgcgacgaagucagcaacucccgcggcaucuacauuuccuccacauccgacaaauucacacccaaacuaggcaccaucggccuccaucaaguacaaggcgacaccgcuucgaaccaacaauccaaauuuacccccgucggcaucgcagucaaccaaaacaccccauucaaacaaugggaacuaccaaacuacucaggcgcccuuacgcucaauacaaaccuagcacccgcagucggcccaaacuuccccggcgaacaaauccucuucuuccgcuccaacguaccauccguucaagguaaccaccccacccaagaaaucgacugccucaucccccaagaauggguaagccacuucuaccaagaauccgcccccucccaauccgacgucgcccuagucagauacguuaaccccgacaccggccgaacuauauucgaagcaaaacuccaccgccaaggcuuuaucaccaucgcagcaacuggcucaaaccccgucguuguacccccaaacggauacuuccguuucgagagcugguaa

SEQ ID NO: 39427 - RNA, 1563 nt, Artificial Sequence
  derived and/or modified sequence opt11 from VP1__Norovirus_and/or_Norovirus-like__KU687023
augaaaauggccucauccgacgccgccccaucaaacgacggcgcagccggccucguccccgaaaucaacacugaaacucuuccccuagaaccugucgccggcgccgccaucgccgcccccgucaccggccaaaacaacaucaucgacccauggauucgaaacaacuucguacaagcccccaacggagaauuuaccgucagcccucgcaacucucccggcgaaauccucaugaaccuagaacucggcccagaucuaaacccauacuuagcacaccuaucccgcauguacaacggcuacgccggcgguguagaaguacagguccuacuagcuggcaacgccuucaccgccggcaaaauacucuucgccgcugucccacccaacuuccccgucgacaugcucuccccagcccaaauaacaaugcucccccaucuaauugucgacguccgcacccucgaacccaucaugauaccccuacccgacguaagaaacgucuucuaucacuucaacaaccaaccagcuccccgcaugcgccuugucgccaugcucuacacuccccugcgcucuaacggcuccggggacgacgucuucaccgucuccugccgaguucuaaccagaccgaccccagacuucgaguucaccuaccuagucccacccuccgucgaauccaaaacaaaacccuucacacuccccauacucacuaucggcgaacucaccaacucccguuuccccgcccccauagaccaacucuacacaagucccaauaccgacauccucguccaaccccaaaauggccgaugcacccucgacggagaacuccaagguaccacccaacuacucacaaccgccaucugcagcuaucgcggcaccacuucuaaucccaccuccgacuacugggacggccaucugcuccaccuuguccacccuaacggagccaccuacgaucccaccgaagacgucccagcccccuucggcacccaagacuuccgcgguauccucuacggcguccucacccaaaacacgcaaaacccccgcgacgaaguuuccaacucccgcggcaucuacaucuccuccaccucugacaaauucaccccaaaacuaggcacgaucggacuccaccaaguacaaggagacaccgccucaaaucaacaauccaaauucaccccagucggaaucgcggucaaucaaaacacccccuucaagcaaugggaacucccuaacuacucaggcgcacucacacucaauaccaaccuagcucccgccgucggaccaaacuuccccggagaacaaauccuauucuuccgaagcaacguccccuccguucaaggcacccacccaacccaggaaaucgacugccuaauaccacaagaauggaucucccacuucuaccaagaauccgcaccaucacaaucggacguagcccuaguccgauauguaaacccagacaccggacgaaccaucuucgaagccaaacuccaccgccagggcuucaucgccaucgcugcaaccggcuccaacccaguaguuguacccccuaauggcuauuuccgcuucgaagcaugguaa

SEQ ID NO: 39428 - RNA, 1563 nt, Artificial Sequence
  derived and/or modified sequence opt11 from VP1__Norovirus_and/or_Norovirus-like__KX764847
augaaaauggccucaaacgacgcaaacccuucagacggaucggccgcuaaccucgucccugaagucaacaacgaaguaauggcccucgaaccuguaguaggagcagccaucgccgccccagucgccggccaacaaaaugucaucgacccuuggauccgaaauaacuucguccaagcccccggcggcgaauuuacagugucaccucgcaacgcaccuggcgaaauacucugguccgcccccuuaggaccagaccuaaacccauaccuaagccaccucgcccgcauguacaacggauacgccggcggcuucgaaguacaagucauucuagccggaaacgcuuucaccgcaggcaagguaaucuucgccgccguucccccgaacuuccccacugaagggcuaucccccucacaagucaccauguucccccacaucguagucgacguccgccagcucgaacccguacuaauccccuuacccgacguacgcaacaacuuuuaccacuacaaccaaagcaaugaccccaccaucaaacucaucgcuaugcucuacacaccccuccgcgccaacaacgcuggagacgauguauucaccgucucaugucgaguccucacucgaccauccccagacuucgacuucauauucuuagucccacccaccgucgaaucccgcacaaaacccuucucaguccccguccuaacaguugaagaaaugaccaacucacgcuuccccaucccccuggaaaaacuuuucaccggccccucuuccgccuucgucguucaaccccaaaacggccgcugcacaacagacggcguucugcucggaacaacccaacuuucacccgucaacaucugcaccuuccgcggcgacgucacccauaucaccgguuccuccaacuacacaaugaaccuagccucccaaaacugguccaacuacgaccccaccgaagaaauccccgcuccccucggcacuccagacuuugucggcaagauucaagggaugcuaacccaaacaaccagaacagacgguucuacccguggacacaaagccaccgucuacacgggauccgccgacuuugcccccaaacuaggacgcguccaauucgaaacagacaccgaccacgacuucgaagccaaccaaaacaccaaauucacccccgucggaguaauacaagacggcucaaccacucaccgcaaugaaccccagcaauggguauuacccagcuauucgggacgcaacacccccaacguccaccucgccccagccgucgcccccaccuuccccggcgaacaacuccucuucuuccguucaaccaugcccggcuguucaggcuaucccaacauggaccuagacugccuccucccacaagaauggguccaauacuucuaccaagaagccgccccggcacaauccgacguggcccuucuccgauucgucaaccccgacaccggccgaguccucuucgagugcaaacuccauaaaucuggcuacgucacagucgcccacaccggacaacacgaccucgucaucccuccaaauggcuauuuucguuucgaagccugguaa

SEQ ID NO: 39429 - RNA, 1563 nt, Artificial Sequence
  derived and/or modified sequence opt11 from VP1__Norovirus_and/or_Norovirus-like__KX764846
augaaaauggccuccaacgacgccaaccccuccgacggcuccgccgcaaaccucguaccagaaguaaacaaugaagucauggcccucgaacccguagucggagcagccaucgcagccccagucgccggacaacagaacguaaucgaucccuggauccgcaauaacuucguccaagcccccggaggcgaguucaccgucucaccccgaaacgcacccggcgaaauccucugguccgcaccacuaggccccgaccucaacccuuauuuaucucaccucgcccgcauguacaacggauacgccggcggcuucgaaguccaagucauccucgccggaaacgccuucaccgccggcaaaguaaucuuugcagccgucccucccaacuuccccaccgaaggccucuccccaucacagguaaccauguucccacacaucgucgucgacgucagacagcucgaacccguacuaauaccgcuacccgacguccgcaacaauuucuaccacuacaaccaguccaaugacccucccauaaaacucauagcaaugcucuacacaccucuucgcgccaacaacgcaggcgacgacgucuucaccgucucaugccgcguccucacccgcccuucacccgacuucgacuuuaucuuccucguaccacccacagucgaaucccgcacaaaacccuucuccguacccguccuuaccgucgaagaaaugacaaacucgcgguuucccauuccccucgaaaaacuauucacgggccccuccuccgccuucgucguacaaccccagaacggcagaugcaccaccgacgguguccuauuaggcaccacccaacucucaccagucaacaucuguacuuuccgcggcgacgucacccacaucacaggcucccgcaacuacaccaugaaccucgccucucaaaacuggucaaacuacgacccaaccgaagaaauccccgccccacuuggaaccccagacuucgucggcaaaauccaaggcaugcucacucagacuacccgaacagacggcuccacucgaggacacaaagcaaccgucuacaccggcucugcggacuucgcccccaaacucggccgaguccaguucgaaacagacaccgaccacgacuuugaagccaaccaaaauaccaaguucacccccguaggaguaauccaagacggcucgacuacacacagaaacgaaccccaacaauggguccuacccuccuacucaggucgcaacacacccaacguccaccuugccccggcagucgcccccaccuuccccggcgaacaacuccucuucuuccgcuccaccaugcccgguugcuccgguuaccccaacauggaccucgacugccuacucccccaagaauggguccaauacuucuaccaagaagccgcccccgcccaauccgacgucgcccuccuccgcuucgucaacccagauacuggccgcguccucuucgaauguaaacuccacaaaucaggcuacgucacugucgcgcacaccggccaacacgaccucgucauaccucccaacggcuacuuccgcuucgacgccugguaa

SEQ ID NO: 39430 - RNA, 1563 nt, Artificial Sequence
  derived and/or modified sequence opt11 from VP1__Norovirus_and/or_Norovirus-like__KX764833
augaaaauggccagcucugaugcaaaccccuccgacggcucugccgccaaccuaguacccgaaguuaauaacgaaguuauggcccucgaacccgucguaggcgccgccaucgccgcccccguagcaggccaacaaaacgucaucgauccauggauccguaacaacuuuguccaagcaccaggcggcgaauuuaccgucucaccccgaaacgccccaggcgaaauucugugguccgcaccccucggacccgaccucaaccccuaccucucccaccucgcccgcauguauaacggcuacgcggguggcuucgaaguacaagucauccucgcaggcaacgccuucacugccggcaaaaucaucuucgccgccgucccaccaaacuuccccacugaaggccucucacccucucaaguuaccauguucccccacaucaucgucgacguacgucaacucgaaccaguucucauaccccuuccagacguccggaacaacuucuaccauuacaaccaaucaaacgacuccaccauaaaacucaucgccaugcucuacacaccccuacgcgccaacaacgccggcgacgacgucuucaccguauccugccgaguccucacccgcccauccccagacuucgacuucauauuccuugucccacccacugucgaaucccgaacaaaacccuuuucaguccccguacucacagucgaagaaaugaccaacucaagauuccccaucccccucgaaaaacuauucacaggccccuccucagcauucgucguccaaccccagaauggccgaugcacaaccgacggaguccuccuaggcacuacccaacucucaccaguuaacaucugcaccuuuagaggcgacguaacccacauaacugggucucgcaacuauaccaugaaccucgccucccaaaacuggaacaacuaugaccccacagaagaaauccccgcaccccucggcacccccgacuucgucggcaaaauccaaggcaugcucacccaaaccacccgcaccgacggcucaacaagaggccaucgagccacaguauacacaggcagcgccgacuucgcccccaaacucggucgcguccaauucgaaaccgacaccgaccacgacuucgaagccaaccaaaacaccaaguuuacacccgucggcgucauacaggacgguucaaccacgcacagaaacgaaccccaacaauggguccuccccucauacuccggccgcaacacccacaauguccaccucgcucccgcagucgcacccacauucccuggcgaacaacuccucuucuuccgcuccacaaugccaggcugcucuggcuacccaaacauggaccuugacugccuccuaccacaagaauggguccaauacuucuaccaggaagccgcccccgcacaaucagacgucgcacuccuacgcuucgucaaccccgacacaggacgcguccuauucgaaugcaaacuucacaaaucaggcuauguaaccgucgcccacaccgggcaacacgaccucgucaucccgcccaacggcuacuuccgauucgacgcaugguaa

SEQ ID NO: 39431 - RNA, 1563 nt, Artificial Sequence
  derived and/or modified sequence opt11 from VP1__Norovirus_and/or_Norovirus-like__KX764834
augaaaauggccuccuccgacgccaaccccuccgacgguucagccgccaaccucguucccgaaguaaacaacgaagucauggcccucgaacccguagucggcgccgccauagcugccccagucgccggccaacaaaacguaauagaccccuggauccgcaauaacuucguccaagcucccggcggcgaguucacggucucaccccgcaacgcucccggcgaaauccucuggagcgcuccccucggccccgaccucaaccccuaccucucccaccucgcacguauguacaacggcuacgcaggcgguuucgaaguccaagucauacucgcaggcaacgcauucacugcuggaaaaaucaucuucgcugccguacccccaaacuuccccacugaaggacuaucucccucacaaguaaccauguucccccauauaaucguggacguccgccaacucgaaccaguccuaaucccccuccccgacguccguaacaacuucuaccacuauaaccaaagcaaugacucaaccaucaaacucaucgccauguuauacacaccccuacgagccaacaacgccggagacgacguauucaccguuagcugccgcguccuaacacgccccucaccugacuucgacuucaucuuccucgucccacccaccgucgaaucccgcaccaaacccuucuccguccccguccuaacaguagaagaaaugaccaacuccagauuccccaucccucuagaaaaacuauucacuggccccuccuccgccuucgucguccaaccccagaacggccgcugcaccacugacggaguacuccucgacaccacgcaacucagccccguaaauauuugcacuuucagaggagacguaacacacauuaccggcucacgcaacuacaccaugaaccucgccucacagaacuggaacaacuacgaucccaccgaagaaaucccagccccacucggcacacccgacuucgucggcaagauucaaggcaugcuaacccaaacuacccgcaccgacggcuccacgcgcggacacaaagcuacugucuauaccggcucugccgacuucgcccccaaacuuggcagaguccaguucgaaaccgacaccgaccaugauuucgaagcuaaccaaaacaccaaauucacuccagucggagucauccaagacggcagcaccacacaccgcaacgaaccccaacaauggguccuaccaucauacuccggccguaacacccacaacguacaccuagcacccgcagucgcgccaacauuccccggcgaacaacuccucuucuuccgcucgacaaugcccggcugcucaggcuaccccaauauggaccuagacugccuccucccccaagaauggguucaauacuucuaccaagaagccgccccagcccaauccgacguugcccuucuccgcuucguaaaccccgacaccggccgcguacucuucgaaugcaaacuacacaaauccggauacgucacuguugcccacaccggccaacacgaccucgucaucccacccaacggauacuuccgcuucgacuccugguaa

SEQ ID NO: 39432 - RNA, 1563 nt, Artificial Sequence
  derived and/or modified sequence opt11 from VP1__Norovirus_and/or_Norovirus-like__KU687027
augaaaauggcaucuaacgacgccaaccccagcgauggcucagcagccaaccucguaccagaagucaauaacgaaguaauggcccucgaacccgucgucggcgccgccaucgccgcacucgucgccggccaacaaaacguaaucgacccauggaucagaaacaacuucguccaagcccccgggggagaguucaccgucucaccccgcaacgcccccggagaaauacucugguccgcaccccuaggccccgaucucaaucccuaccuuucccaccuagcccgcauguacaacgguuacgccggcggcuucgaaguccaagucauccuagcaggcaacgccuucaccgccggcaaagucaucuuugcagccgucccacccaacuuccccaccgaaggucugucccccucccaaguaaccauguuuccccacaucgucguagacguacgccaacuagaaccuguccucaucccacucccagacguucgcaacaacuucuaccacuacaaccaauccaacgacccuacaaucaaacuaaucgcaaugcucuacaccccacuacgagcaaacaacgcaggcgaagauguauucaccgucuccugccgcgugcucacacguccuagccccgauuuugacuucaucuuccucgucccacccaccguggaaucacgcaccaaacccuucuccguccccguacuuacagucgaagaaaugaccaacucuagauuccccauaccccuagaaaaacucuucaccggccccucuuccgcauucgucguacaaccccagaacggccgauguaccaccgacggcgucuuacuaggcacuauccaacucucucccguaaacauaugcaccuuccgaggagacgucacacacaucacaggauccagaaacuacacaaugaaccuagccucccaaaacuggaacgacuaugacccaacagaagaaauuccggcaccccugggaacccccgacuucguaggcaaaauacaaggaaugcucacccaaaccacccgcaccgacggcagcaccagaggucacaaagcaaccgucuacaccggcuccgccgacuuugcccccaaacuuggccgcguacaauucgaaaccgacaccgaccacgacuucgaagccaaccaaaauaccaaauucacacccgucggugucauccaagacggcuccaccacacaccgaaacgaaccacaacaauggguacuaccaagcuacuccggccguaacacccccaacguacaccucgcccccgccguagcacccacguuucccggcgaacaacuccuguucuuccgaucuaccacaccagguugcuccggcuaccccaacauggaccuagacugccuccucccacaagaguggguccaauacuucuaccaagaagcugcccccgcccaaucagaugucgcccuccuccgauucgucaacccagacaccggccguguacuauucgaaugcaaacuacacaaaagcggcuacgucaccgucgcacauaccggccaacacgaccuugucaucccacccaacggcuacuuccgauucgaauccugguaa

SEQ ID NO: 39433 - RNA, 1563 nt, Artificial Sequence
  derived and/or modified sequence opt11 from VP1__Norovirus_and/or_Norovirus-like__KX764835
augaaaauggccucaaacgacgcaaaccccucggauggcucagccgcaaaccucguacccgaaguaaacaacgaagucauggcccucgaacccgucgucggcgccgccaucgcagcacccguagcaggccaacaaaacgucauagacccauggauccgaaacaacuucguccaagcccccggaggagaguucaccguaucccccagaaacgccccaggagaaauacuaugguccgcaccccucggcccugaccuaaaucccuaccuaucacaucucgcccgcauguacaacggauacgcgggcgguuucgaaguacaagucauccuagcaggcaacgccuucaccgccggcaaaaucauuuucgcagcagucccacccaauuuccccacagaagggcucucccccucccaagucacaauguucccccacaucaucgucgacguaagacaacucgaacccguccucaucccacucccagacguccguaacaacuucuaccacuauaaccaaagcaacgacagcaccaucaagcuaauagccaugcuauacaccccaccccgagccaacaacgccggcgacgacgucuucacaguaagcugccgcguccucacccgccccuccccugacuucgacuucaucuuccucgucccacccacaguugaaucacggaccaaacccuucagcguccccguccuaacagucgaagaaaugaccaacucccgcuuccccaucccgcuagaaaaauuauucacuggccccagcuccgcauucguaguccaaccccaaaacggccgaugcacaaccgacggcguacuccuaggcaccacccaacucucccccgucaacaucugcaccuuccgcggcgacgucacccacaucaccggcuccagaaauuacacaaugaaccuugccucccaaaauuggaacaacuacgacccaacugaagaaaucccugcuccacucggcacccccgacuucgucggcaagauccaagguaugcucacucaaaccacccgaaccgacggcuccacacgcggccacaaagcaaccguauacacaggcagcgcagacuucgcacccaaacucggacgaguccaauucgaaacagacaccgaccacgauuucgaagccaaccaaaacacaaaauucacaccggucggcgucauacaggacggcuccacaacccaucgcaacgaaccccaacaauggguccuccccuccuacucaggcagaaacacacacaacguccaccucgccccagcggucgccccuaccuucccaggcgaacaacuccucuucuuccgauccaccaugcccggcugcucaggcuacccuaacauggaccuagacugccuucugccccaggaauggguccaguacuucuaccaagaagccgcaccagcccaauccgacgucgcccuccuccguuucgucaaccccgacaccggccgcguccucuucgaaugcaaauuccacaaauccggcuacgucacagucgcccacaccggacaacacgaucucgucaucccacccaacggauacuuccgcuuugaaucaugguag

SEQ ID NO: 39434 - RNA, 1563 nt, Artificial Sequence
  derived and/or modified sequence opt11 from VP1__Norovirus_and/or_Norovirus-like__KX764832
augaaaauggccucaaaugauguaaaccccuccgacggcuccgccgccaaccucguucccgaagucaacaacgaagucauggcccuugaaccugucgucggagccgccauugccgcccccgucgccggccaacaaaacgucaucgauccguggauacgcaacaacuucguccaggcaccaggcggcgaguucacgguuuccccacgaaacgcccccggcgaaauccucugguccgcaccccucggccccgaccucaacccauaccucucccaccucgcccgcauguacaacggauacgccggcggauucgaaguccaagucauacucgcaggaaaugcauucaccgccggcaaaaucaucuucgcagccgucccaccaaacuucccuaccgaaggacuaucacccucucagguaaccauguucccccacaucauaguagacguacgacaacuagaaccaguucuuaucccacuaccagacguccgcaacaacuucuaccacuauaaccaaucuaacgacucgaccauaaaacuaauugccaugcucuacaccccacuccgugccaacaaugccggugacgacgucuucaccgucuccugccgaguccucacccgccccucccccgacuucgacuucaucuuccucguaccaccuacugucgaaagccgcaccaaacccuucuccguuccaguacucaccgucgaagaaaugaccaacucccgcuuccccauaccccucgaaaaacuauucaccggcccguccuccgcauucgucguccaaccccaaaacggccgcugcaccaccgacgggguccuccucggcaccacccaauuaucccccgucaacauaugcaccuucagaggcgacgucacccacauaacaggcucacgaaacuacaccaugaaccucgcuagccaaaacuggaauaacuacgacccuacagaagaaauccccgccccacucggcacccccgacuucguaggcaaaauccaaggaaugcuaacccagaccacacgcacugaugguuccacucgcggacacaaagccacuguauacaccggcuccgccgacuucgcgcccaaacuaggccgcguccaauucgaaacagacaccgaccacgacuucgaagccaaccaaaacaccaaauucacacccgucggcgucauccaagacggcucaaccacacaccgcaacgaaccucaacaaugggcccucccguccuacucaggaagaaacacccacaacgugcaccuagcuccagccgucgcccccacauucccaggcgaacaacuccuauucuuccgcuccacaaugccaggauguuccggcuaccccaacauggaccuagacugcuuacucccccaagaauggguccaauacuucuaccaagaagccgcccccgcccaauccgacgucgcccuccuccgcuucguaaaccccaacacaggccgcguccucuucgaaugcaaacuccauaaauccggacaugucaccguagcccauaccggccaacaugaccucgucaucccaccaaacggcuacuuccgcuucgacuccugguaa

SEQ ID NO: 39435 - RNA, 1563 nt, Artificial Sequence
  derived and/or modified sequence opt11 from VP1__Norovirus_and/or_Norovirus-like__KU687025
augaaaauggccucaaacgacgccaaucccuccgacggauccgccgcaaaucucguuccugaagucaacaacgaagucauggcucucgaacccgucguaggagccgccauagcagcccccgucgcuggacaacagaacgucauagaccccuggauccgaaacaacuucguccaagcacccggaggcgaguucacagucagcccccgaaacgccccaggugaaauccucugguccgcaccccucggcccagaccuaaacccauaccuaucccaccucgcccgaauguacaacggcuacgcaggcggcuucgaaguccaagucguacucgccggaaacgcuuucacagcuggaaaaguaauauucgccgcuguucccccuaacuuccccaccgaagaccucagcccaucccagguuacaauguuuccccacaucgucguugacguucgccaacucgaacccguuuuaaucccccuccccgacgucagaaacaacuucuaccacuacaaucagucaaacgacccuaccaucaaacuaaucgcaaugcuuuacacuccccuacgcgccaacaacgccggagaagacguauucaccgucuccugccgcguccucaccagacccuccccagacuucgacuucaucuuccuugucccacccaccguagaaucccggaccaaacccuucagcguacccguccuuacuguagaggaaaugaccaacucacgauuccccaucccccucgaaaaacucuucacaggccccuccuccgccuucgucguacaaccccaaaacggacgcugcaccacagacggcguccuacuaggcaccauccaacuauccccagucaacaucugcacauuccgcggcgacgucacccacaucacagguagccgcaacuacacaaugaaccucgccucccaaaacuggaacaacuacgacccuaccgaagaaauccccgcaccccucggcacccccgacuucguaggcaaaauccaaggcaugcuuacacaaacaacucgcaccgacggcucaacacguggacacaaagccaccgucuacaccggauccgccgauuucgcccccaaacuuggccgcgcgcaauucgaaaccgacacugaucacgacuucgaagcaaaucaaaacaccaaauucacccccgucggcguuauccaagacggaucaacuacccaccgcaacgaaccccaacaauggguccuucccucguacuccggacgcaacacucccaacguccaccuugccccugcugucgccccaaccuucccgggagaacaacuacucuucuuccgcuccaccacccccggcugcuccggcuaccccaacauggaucucgacugccuccucccccaagaauggguacaauauuucuaccaagaagccgcccccgcacagucagacgucgcccuacuccgguucguaaacccagauacaggccgcguacuuuucgaaugcaaacuacacaaauccggcuacgucaccguugcccacgccggccaacacgaccucgucauaccacccaacggauacuuccgcuucgaagccugguag

SEQ ID NO: 39436 - RNA, 1563 nt, Artificial Sequence
  derived and/or modified sequence opt11 from VP1__Norovirus_and/or_Norovirus-like__KU687026
augaaaauggcgagcucagacgcuaacccgucagacggcuccgccgccaaccucguccccgaagucaacaacgaagucauggcccuugagccaguagucggcgcagcaaucgcagcccccguugccggucagcaaaacgugaucgaucccuggauccgcaacaacuucguccaagccccaggcggagaguucaccgucucaccccgcaacgcccccggcgaaauacuaugguccgccccacucggaccagaccucaacccuuaccucucccaccuagcacgaauguauaacggcuacgccggcggauucgaaguacaagucauccucgccggcaaugccuucacugccgguaaagucauauucgccgccguuccaccuaacuucccaacagaagggcucuccccaucccaaguaaccauguucccccacaucgucguagacguuagacaauuagaacccguacucaucccccucccugacguccgcaacaauuucuaccacuacaaccaguccaacgaccccaccaucaaacuaauagcaaugcuguacacgccucucagagccaacaacgccggagaagaugucuucaccgucucuugcaaaguccucacccgacccucacccgauuucgacuucauuuuccucguaccucccacugucgaaucaagaacaaaacccuucuccguccccguccuaaccguagaagaaaugaccaacucccguuuccccaucccccucgaaaaacuuuucacugguccauccucagcauucgucguacagccacaaaauggucgcugcacaacagacggcguacuccucggcaccauacaacugucacccguaaacaucugcacauuccgcggagacgucacacacauaaccggcucccgcaacuauaccaugaaccuugcaucccagaacuggaacaacugcgacccuaccgaagaaauccccgccccacucgguacaccugacuucgucggcaaaauccaaggcaugcucacucaaacaacaagaaccgauggcuccacacgaggacacaaagccaccgucuacaccggcucagccgacuucgccccaaaacuaggccgaguccaauucgaaaccgacacagaccacgacuucgaagccaaccaaaacaccaaauucaccccagucggugucauccaagacggauccaccacccaccgcaacgaaccacaacaauggguacuccccagcuacuccggccguaacaccccaaacguccaccucgcccccgcaguagcuccaacauuccccggcgaacaacuccucuucuuccguuccaccaccccaggcugcuccggcuaccccaacauggaccucgacugccuccucccacaagaauggguccaauacuucuaccaagaagcagcaccggcacaaagcgacgucgcccuccuacgcuuugucaauccagacaccggccgcguacucuucgaaugcaaacuacacaaaagcggauacguaaccgucgcacacacaggccaacacgaccuaguaauaccucccaacggcuacuuccgcuucgacgccugguaa

SEQ ID NO: 39437 - RNA, 1563 nt, Artificial Sequence
  derived and/or modified sequence opt11 from VP1__Norovirus_and/or_Norovirus-like__KU687028
augaaaauggccuccaacgacgccaaccccucagacggguccgcagcaaaccuaguucccgaggucaacaacgaaguaauggcccucgaacccgccgucggcgcagccaucgccgccccagucgccggccaacaaaacguaaucgacccuuggauccggaacaacuucguccaagcccccggcggagaguucaccgucucaccccgaaacgcccccggcgaaauccucuggucagcaccccucggacccgaccucaaccccuauuuaagccacuuagcccgcauguacaacggcuacgccggcggcuuugaaguucaaguaauccucgccggcaacgccuucgccgccggcaaagucaucuuugccgccgucccacccaacuuccccaccgaaggccucucucccucacaagucaccauguucccccacauaguagucgacguacgccaacucgaacccguccucaucccccuccccgacguccgcaacaacuucuaccauuacaaccaauccaacgauccaacaaucaaacuaauagccaugcucuacacaccacuuagagcuaacaacgccggcgaagaugucuucaccguauccugccgaguccucacccguccuuccccagacuucgauuuuaucuuucucgucccacccacaguagaaucacgcaccaaacccuucucaguacccguucucaccguagaagaaaugaccaacucccguuuccccaucccacucgaaaaacucuucaccggccccuccucagccuucguaguacaaccucaaaacggccgcugcacuaccgacgguguccuccucggaaccauccaacucucccccguaaauaucuguaccuuccgcggagacgucacccacaucaccggcucucgcaacuacaccaugaaccuagcgucccaaaacuggaacaauuaugaccccaccgaagaaaucccagccccgcucggcacucccgacuucguaggcaaaauacaaggaaugcucacacagacaacacgcacagacggauccacccgcggacauaaagccaccgucuacacagggucagccgacuucgcccccaaacuaggcagaguacaguucgaaaccgacaccgaccacgacuucgaagccaaccaaaacaccaaauucacccccgucggcgucauccaagacggcuccaccacccaccggaacgaaccacaacaauggguacuacccuccuacuccggccgaaacaccccaaacguacaccucgcccccgccgucccucccacauucccaggagaacaacuucuuuucuucagauccaccacaccaggcugcucaggcuacccuaacauggaccuagauugccuccucccccaagaauggguccaauacuucuaccaagaagccgcacccgcucaauccgacgucgcucuccuccgauucgucaaccccgacacaggccgcguccucuucgaaugcaaacuccacaaaucuggguacgucaccguagcccacaccggccaacaugaccuuguuauacccccaaacggcuacuuccgcuucgagagcugguga

SEQ ID NO: 39438 - RNA, 1563 nt, Artificial Sequence
  derived and/or modified sequence opt11 from VP1__Norovirus_and/or_Norovirus-like__KX764831
augaaaauggccuccucagacgucaaccccucagacggauccgccgcuaaccuugucccagaagucaacaacgaagucauggcccuagaaccaguaguaggcgcagcuaucgccgcccccgucgccggccaacaaaauguaaucgacccuuggauccgcaacaacuucguccaagcccccggcggcgaguucaccguaucaccacgaaacgcccccggugaaauacucuggucagcuccauugggcccagaccucaaccccuaccucucccacuuagcccgaauguacaacggauacgccggcggcuucgaaguccaagucauacucgcaggcaacgccuuuacagccggcaaaaucauauucgcagccgucccgcccaacuuucccaccggaggccucucccccucacaagucaccauguucccccacaucaucguugacguacgccaacuagaaccaguccucaucccccuccccgacguccgaaacaacuucuaccacuauaaucaaucgaacgacuccacaauaaaacuuaucgcgaugcucuauacaccacuccgcgccaacaacgcgggcgacgacgucuucaccgucuccugccgaguccucacacgccccucaccagacuuugacuucaucuuccuagucccaccaacugucgaaucccgcaccaagccauucuccgucccaguccuaaccgucgaagaaaugaccaacucccgauuccccauaccucuugaaaaauuauucaccggccccuccuccgcauucguuguacaaccccaaaacggacgcugcaccaccgacggcguccuacuaggcaccacccagcucucccccgucaacaucugcaccuuccgaggcgacguaacccacaucaccggcuccagaaacuacaccaugaaccucgccucccaaaacuggaacaacuacgaccccaccgaagaaaucccugccccacucgguaccccagacuucguaggcaaaauccaagguaugcucacccaaaccacacgcaccgacggcccaacccgcggccacaaagccaccgucuacacaggauccgccgacuucgcccccaaacucggacgcguacaauucgaaacagacaccgaucacgacuuugaagcaaaccaaaacacaaaauucacccccguaggaguaauccaagacggcuccaccacccaccgcaacgaaccccaacaauggguccuucccucauacucuggcagaaacacacacaacguccacuuagcccccgccgucgcccccacauucccuggcgaacagcuacucuucuuccgaucaaccaugccugguugcucuggauacccaaacauggaccucgauugccuacucccccaagaauggguccaauacuucuaccaagaagccgcucccgcccaauccgacgucgcacuccuccguuucgucaauccagacacuggccgcguacuauucgaaugcaagcugcacaaauccggcuacgucaccgucgcccacaccggccaacacgaccuagucaucccucccaacggcuacuuccgauucgaagccugguaa

SEQ ID NO: 39439 - RNA, 1560 nt, Artificial Sequence
  derived and/or modified sequence opt11 from VP1__Norovirus_and/or_Norovirus-like__JN222366
augaugauggccaguaaagacgccccuaccucccccgacggcgcauccggcgccggccaacucguacccgaagcaaauaccgcagaacaaauaucuauggaccccgucgccggcgccuccaccgcuguugccacagccggccaaguaaacaugaucgaccccuggauauucaacaacuucguccaggcaccccaaggcgaguucaccauaucccccaacaacacaccaggcgacauccucuucgacuuacaacugggcccucaccuaaaccccuuccuagcccaccucucccaaauguacaacggauggguuggaaacaugcgaguucgcauccuccuagccggcaacgccuucaccgccggaaaaauaaucaucugcugugucccacccggauucgacgcccgcauccucaccaucgcacaggccacccucuucccacaccucaucgcggacguccgcacucuagaaccuguagaacucccccucgaagauguccgcaacguccuauaccacaauucaucccagccccaacccacaaugcgucuuguugcuaugcuauacacaccccuaagaaccggcggaggcuccggcggcacagaugccuucgucgucgccggccgcguacuaaccugcccagcccccgacuucuccuuccucuuccuagucccucccuccgucgaacagaaaacccgcgucuuuagcguccccaauauaccccuuaaagaccucuccaacucacgcguccccguaccaauccagggcauguucaugagcccagacguaaaccaauccguccaauuccaaaacggccgcugccaaauagacggccaacuccaaggcaccacccccguaucacucucacaacucugcaaaauccgcggcaaaaccuccuccaacgcccgcguccugaaccucucagaaguagauggcaccccuuucauuccccucgaaucucccgcccccguuggauucccagaccucggcggaugcgacuggcacgucaauuucaccuuccaagcacaaaaccaagacccaucacaauccgucacauucgccacaaacgacgccucauucgucccauaccuaggcuccaucucaccccacaacggcggugauuuccacgcuggcgacauaaucggcucccuaggauggauauccgcccccuccgacaacucccaacucaacgucuggacaaucccaaaauauggcuccucacuacccgacguaacccaccuagcccccgcaguuuuucccccaggauucggcgagguaauccucuacuucuacucaaccuuccccggcuccggccaaccaucacaacuccaagucccaugccuacucccccaagaguucaucacccacuuuugcaaugaacaagcccccaucgccggcgaagcugcccuccuccacuacgucgacccagacaccggccguaaccucggagaauuuaaacucuacccugacgguuucaugacuugcguuccaaacucugucagcuccggcccacaaacccuucccaucaacggcgucuucgucuucgucucuugggucagccgcuaa

SEQ ID NO: 39440 - RNA, 1557 nt, Artificial Sequence
  derived and/or modified sequence opt11 from VP1__Norovirus_and/or_Norovirus-like__KM386679
augaagauggccucaaacgacgcuacccccagcaacgacggcgccgccggacugguacccgaaagcaacaacgaagccauggcccuagaaccagucgucggcgcaucacucgccgccccaguaaccggccaaaccaacaucaucgacccauggauccgcaccaacuucguccaagcccccaacggcgaguucacagucuccccaagaaauuccccaggcgaaauccuagucaaccucgaacucggcccggaacucaaucccuaccucgcccaccucgcacgcauguacaacggauacgcaggcggcauggaaguacaagucaugcucgccggcaacgccuucacagcaggcaaaauaauauucgccgccguaccucccuacuuccccguagaaaaucucucacccucccaaaucaccauguucccccacgucauaaucgacguacgcacccuagaacccguccuccuaccaaugcccgacguaagaucuacccuauuccacuucaaccaaaaagaugagcccaaaaugagacucgucgccaugcucuacacaccccuucgaucuaacggcuccggcgacgacgucuucaccgucuccugcagaauccuaacacgcccgucccccgaguucgacuucaccuaccucguaccacccaccgucgaaucaaaaaccaagccauucacacuaccaguacucacacucggcgaacucucaaacagcagauuuccacuuuccaucgacgaaauggucaccagcccaaacgaaucaaucguugugcaaccacaaaacggccgcguaacucucgacggagaacuuuuaggaacaacccaacuccaagccugcaacaucugcucgauccgcggcaagguaacaggccaaguucccaacgagcaacacauguggaaucucgaaaucaccaaccucaacgguacccaauucgaccccaccgacgacguacccgcaccccuaggcguccccgacuucgccggcgaagucuucggcguacuaucucaacgcaaccgcggcgaaucaaaccccgccaacagagcccaugacgccguaguggccaccuacucagacaaauacacccccaaacucggacuuguacaaaucggcaccuggaacaccaacgacguggaaaaccaaccaaccaaauucacccccaucggccucaacgaaguagccaacggccaccgcuucgaacaauggacccucccccgcuacucaggcgcgcucacccucaacaugaaccucgccccagccgucgcuccccucuucccgggcgaacggcuacucuucuucagaagcuacgucccccucaaaggcggauucggaaacccggccaucgacugccucgucccacaagaauggguccaacacuucuaccaagaaucagccccaucucugggcgacgucgcccuuguccgcuaugugaaccccgacaccggccgcguacucuucgaggccaaacuccacaaaggcggauuccuaacagucucauccacuucaaccggccccgucguaguccccgccaacggcuacuuccgauucgacuaa

SEQ ID NO: 39441 - RNA, 1551 nt, Artificial Sequence
  derived and/or modified sequence opt11 from VP1__Norovirus_and/or_Norovirus-like__AY549156
augaaaaugacugaccgcgauaccguagacucugcccccgcccuaggccaggugcucccacccgaggucgaagccucuguucccgucgaacccacagccggugcccccguagcagcucccaccgcaggccaagucaacccgaucgaccccuggaucuuugcaaacuuuguccaagcaccacaaggcgaauuuaccauuucccccaacaacaacccaggcgaaauacucuucgaacuagaacucggcccagaccuuaaccccuaccuagcccaccuacgccgcauguacaacggauggaccggcucaaugcgcguccgcguccuacuagccgggaaugcauucuccgcuggaaaaguaguuguauuuugugucccacccggcuucgauacaagcuaucucaccccaucccaggcuacccaauucccgcacguccucaucgacguccgcgcccccgagcccguugaaaugccccuagaagacguacgaaacauccuauuccaccaaggacccgacucccgcaugcgccucaugggcaugcuauacacgccccuccgcgccaacagcggcgccgaccccuucguuguaaccggccgcguccugacaugccccucccccaacuucucauucuucuuccucgucccacccacagucgaagaacgcgaaccacccuuuacccuacccaaccuccccgucaacaaucuaagccacucccgugucauggaacccaucgcacaaaugaugucaucccgaaacuuccccgcuuccguccaauuccaaaacggccgcugcacacuuuccggcgaccuccuaggaaccaccccaucaucccccgccgaccucggagccuucgucggacuaagagcugaaccaggaucccgaguggucgaacucucacaaccaaaccaagaagacuuccacgccggaucagcacccgccccauucggcuucccagacuucuccgacugcucugucaccuuugucgucgcauccgccacaaccgucggcgaaagaacuguaaacacccguucccuccaaaacuucacacccgcucucggucacaucacauucgacgaagaagcucccgcugaucucuuccgagcccauuuccgaaaccuaugggaaccaacugaacacucuuucuggcguauucccgacuaccgagcugacguccuaggcuccgacuucgcccccucagucuccgcccccggcgucggagaaacccuucuuuucuucaugugcaacgucccacgacuuaauggcgcaaaccccaaccccugccccugccuccuaccccaagaauggaucacccacuucgucuccgaacgcgcugcccuacaaucagacgucgcacuccugaacuacgucaacccuaacacuggcagaguacucuucgaagcaaaacuuuacgccaacggcuuccuaaccgugaaccucggcgccccugaccaagccacccuccccguugacggcaucuuuaaauucguauccugggucagcuccuacuaccaacuccggccuguaggcaaugccuccgccggccgccgacuauaa

SEQ ID NO: 39442 - RNA, 1551 nt, Artificial Sequence
  derived and/or modified sequence opt11 from VP1__Norovirus_and/or_Norovirus-like__AY549163
augaaaaugacagacagagacacaaucgauucugcccccgcacucggccaaguccucccgccugaaguagaagccuccguccccgucgaacccaccgcaggcgcccccgucgccgcccccacugccggccaaguuaacccaaucgaccccuggauauuugccaacuucguccaagccccucaaggcgaguucacuaucuccccaaacaacaacccaggcgaaauacuauucgaacucgaacuaggccccgaccucaacccauaccucgcccaccuaagaagaauguacaacggcuggaccggauccaugcgaguaagaguccuccucgccggaaacgccuuuucagccgguaaagucguaguuuucugcgucccacccggauucgacaccuccuaccuaacucccucccaagccacccaauuuccccacguacucaucgaugucagagcgcccgaaccagucgaaaugccacuagaagauguccguaacauccucuuccaccaaggaccagacucacgcaugcgccucaugggaaugcuauacaccccacuccgcgccaacuacggcgccgaccccuucgucguaaccgggcgaguccucacaugccccuccccaaacuuuucauucuucuuucucgucccucccaccguagaagaacgugaaacacccuuuacgcucccgaaccuaccaguuaacaaccucucccacucacgcguuauggaaccaaucgcucaaaugaugucuucacgaaacuuccccgccuccguucaauuccaaaacggccgaugcacccucucaggugaccuacuuggcacaacccccuccucccccgccgaucuaggagccuucgucggccuccgugcagaacccggcagucgcgucgucgaacucucacaacccaaccaagaagacuuccaugcaggcucugcacccgcccccuuuggauuccccgacuucucagacugcucggucaccuucguaguagccuccgccacaacuguaggagaacgcacagucaacacccgcucacuacaaaacuuuaccccagcccuaggacacaucacauucgacgaagaagccccagccgaccuauuccgcgcacacuuccgaaaccuaugggaaccaaccgaacauucauucuggcgcauccccgacuaccgcgccgacguacuaggaagugacuucgccccauccgucucugcaccaggcgucggagaaacccuccucuucuucaugugcaacgucccccgccuaaauggcgcaaaccccaaccccugcccaugccucuuaccccaagaauggaucacccauuucguauccgaacgagccgcccuacaauccgacgucgcccuccucaauuaugucaaccccaacaccggacgcguucucuucgaggccaaacuauacgcaaacggcuuccuuacugucaaucucggagccagcgaccaagccauucuccccgucgacggcaucuucaaauucgucuccugggucagcuucuacuaccaacuccgacccguaggcaacgccagcgucggccgccgacucuaa

SEQ ID NO: 39443 - RNA, 1551 nt, Artificial Sequence
  derived and/or modified sequence opt11 from VP1__Norovirus_and/or_Norovirus-like__AY549159
augaaaaugaccgaccgagacaccguagacucugcccccgcccuaggacaaguccucccacccgaagucgaagccuccguccccgucgaacccacagccggugcccccgucgccgcaccaaccgccggacaaguaaaccccauagacccauggaucuucgccaacuucguacaagcaccacaaggcgaguucacaauaucacccaacaacaacccaggcgaaauccuauuugagcucgaacuaggcccagaccucaaccccuaccuagcccaccuccgccgcauguacaacggcuggaccgguuccaugcgcguacgaguccuccucgccggcaacgcauucuccgcagguaaaguagucgucuucugcgucccacccggcuucgacaccagcuaccuuacccccucccaagccacccaauuuccccacguccucaucgacguucgugcacccgaacccguagagaugccccuagaagacguccgcaauauccuauuccaccaaggccccgacagccgcaugcgccucaugggcaugcuauacacaccccuuagagccaacucuggagcagaccccuucguagucaccggcagaguccuaaccugcccaucacccaacuucuccuucuucuuccucguuccacccaccgucgaagaacgcgaaacccccuucacccucccaaaucuaccagucaacaaccucucacacucccgaguaauggaaccaaucgcccagaugauguccagccgcaacuuuccugccucaguccaauuucaaaacggccgauguacccuuucuggagaccuccugggcaccacucccucuucccccgccgaccuaggcgccuucgucggccuacgcgcagaacccggcucccgcguagucgaacuaucacaacccaaccaagaagacuuccacgccggcuccgcccccgcaccuuucggcuuccccgacuucucagacugcucagucaccuucgucgucgcauccgccaccaccgucggcgaaagaaccgucaacgcacgaucccuccaaaacuucacacccgcccuaggccauauaaccuucgacgaggaggcuccagcggaccuauuccgcgcccaccuccguaaccuuugggagccaacagaacacuccuucuggcguauacccgacuaccgcgcugacguucucgguucagacuucgccccaagcgucuccgccccaggcguuggcgaaacccuccuauucuucaugugcaacguaccccgccugaacggagccaaccccaaccccugcccaugccuccuaccccaagaauggaucacccacuucgucuccgagcgcgccgcacuccaauccgacguagcucuccucaacuacgucucccccaacaccggccgcguacucuucgaagccaaacucuacgcaaacggguuccuaaccgucaaccuaggagccucagaccaagcaacccuaccagucgauggcauuuucaaauucgucuccuggguuuccuucuacuaccaacuccgcccugucggcaaugccucaguaggccgacgccucuaa

SEQ ID NO: 39444 - RNA, 1551 nt, Artificial Sequence
  derived and/or modified sequence opt11 from VP1__Norovirus_and/or_Norovirus-like__AY549166
augaaaaugaccgaccgagauaccgucgacuccgcccccgcgcucggacaaguacuaccucccgaaguugaggcuucaguacccguagaaccaacugccggcgccccaguagcagcaccaaccgccggccaagucaacccaauagaccccuggauuuucgccaacuucguccaggccccacaaggugaguucaccauaucucccaacaacaaccccggcgaaaucuuauucgaacucgaacucggcccagaccuuaaccccuaccucgcccaccuucgacgcauguauaacggcuggaccggcuccaugcgaguccgcguacuccuagcuggaaacgccuucuccgccggcaaagucgucguauucugcguacccccaggcuucgacacauccuaccucaccccaucacaagccacacaauucccccacguccugaucgacguacgcgcccccgaaccuguagaaaugccacuagaagacguucgaaacauccuuuuucaccagggcccagacucacggaugcgacuaaugggaaugcuauacaccccacuccgagccaacuccggcgcagacccauucguaguaaccggucgaguucuaacaugcccuuccccaaacuucuccuucuucuuucucguacccccaaccguugaagaacgagaaacccccuucacccuacccaaccuccccgucaauaaccucucccacucccguguuauggaacccaucgcccaaaugauguccagcagaaacuucccagcuucuguccaauuccaaaauggacguugcacccucuccggugaccuccucggcaccacucccuccucaccagccgaccucggugcauucguuggucuacgugccgaaccaggaucccgcgucguagaacucucccaaccaaaccaagaagacuuccacgccggcuccgcucccgcaccauucggcuuccccgacuucucugacugcaguguaaccuucgucgucgccucagccaccaccguaggcgaacgcaccgucaacacacguucucuucaaaacuucacacccgcacugggccacaucaccuucgacgaagaagcaccagcagaccuauuccgcgcacacuuccgcaaccucugggaacccaccgaacacagcuucuggcgcauucccgacuaccgagcggacguccucggcucagacuucgcccccucuguauccgcaccaggagucggcgaaacacuccucuuuuucaugugcaaugucccccgacuaaacggcgcuaacccuaaccccuguccaugccuccucccccaagaauggaucacgcauuucgucucagaacgugcagcacuccaauccgacgucgcccuucucaauuacgucaaccccaauacaggacgaguccuacucgaagccaaacucugugcaaacggcuuccucacaguuaaccucggagccuccgaccaagcuacccuccccgucgacgguaucuucaaauucgucuccuggguauccuucuacuaccaacuacgccccgucggcaacgccucuguuggacgccggcucuaa

SEQ ID NO: 39445 - RNA, 1551 nt, Artificial Sequence
  derived and/or modified sequence opt11 from VP1__Norovirus_and/or_Norovirus-like__AF320113
augaaaaugaccgaccgugacaucaucgacucugcccccgcccucggccaaguccucccucccgaagucgaagccuccguccccguagaacccaccgccggcgcacccguagccgcccccaccgcaggacaagucaaccccaucgaccccuggauauucgccaacuucguccaagcaccccaaggugaguucacaaucuccccaaauaacaacccuggggaaauccucuucgaacuugaacuaggaccagaccuaaacccguaccuagcccaccuccgccgcauguacaacggcuggacuggcucuaugcgcguccgaguccuccucgccggcaacgcauucucagccggaaaggucguugucuucugcguacccccaggauucgacaccucauaccuaacaccuucccaagccacccaauucccccacguccucaucgacguacgagccccggaaccugucgaaaugccacucgaagauguccgcaacauacucuuccaccaaggccccgauucacgcaugcgccuaauggguaugcucuacacuccacuccgcgccaacagcggcgccgaccccuucgucgucaccggccgaguucuacccugccccucacccaacuucagcuucuucuuccucguacccccgaccgucgaagaacgcgaaccucccuucacccuccccaaccuccccgucaacaaucucucucacucgcggguuauggaacccaucgcccaaaugaugucaucacgcaccuuccccgccagcguucaauuccaaaacggccgaugcacccucuccggcgaccuacucggaaccacccccuccucucccuccgaucuaggagcauucgucggccucaucgcagaacccggaucacgaguuguagaacucuuccaacccaaccaggaagacuuccacgcaggcucugcccccgccccacucgguuuccccgacuuuuccgacugcucccuuaccuuuguaguagccuccgccaccacagucggagaacguacaguaaacgcucgaucucuccaaaacuuuacacccgcucuaggccauaucaccuucgaugaagaagcuccagcugaucuauuccgcgcacaccuccgaaaccucugggaccccaccgaacacagcuucuggcggauucccgacuaccgcgccgacguccuaggaucagaacucgcaccgucagucuccgcacccggagucggcgaaacucuucuauucuuuaccugcaacgucccccgucucaacggcgccaacccuaaucccuguccaugccuccuaccccaagaauggaucacacacuucgucucugaacgugcagcccuccaauccgacgucgcccuacucaacuaugucaacccuaacaccggacgaguccucuucgaggccaaacucuacgucaacggcuuccucacaguaaaccucggcgcaucugaccaagccacccuacccgucgacggcauuuucaaauucgucucaugggucucuuucuauuaccaacuccgccccguuggcaacgccuccgucggccgccgucucuag

SEQ ID NO: 39446 - RNA, 1551 nt, Artificial Sequence
  derived and/or modified sequence opt11 from VP1__Norovirus_and/or_Norovirus-like__AY549153
augaaaaugaccgaccgcgacaccgucgacucagcccccgcccuuggccaaguccucccacccgaagucgaagccuccguaccugucgaaccaacagcaggcgcccccguagccgcucccaccgccggccaagucaaccccaucgaccccuggauauucgccaauuucguucaagcaccccaaggcgaguucacaaucucacccaacaacaaccccggagaaauacucuucgaacucgaacucggcccugaccuaaacccauaccuagcccaucuucgccgaauguacaauggcuggaccggcuccaugcgcguccgcguccuccucgcaggcaacgccuucuccgcaggcaaagucgucgucuucuguguacccccuggcuucgacaccuccuaccuuacucccagccaggccacacaauucccacacguccuuaucgacguccgggcacccgaacccguagaaaugccccucgaagacguacgcaacauccucuuccaccaaggccccgauucccgcaugcgccucauggguaugcuauacacaccccuccgcgccaacucgggcgccgacccauucgucguaaccggccgcguacuaaccugcccaucaccaaacuucucauucuuuuuccucguacccccaacugucgaagaacgugaaccacccuucacacuccccaaccuccccguuaacaaccucucccacucacgcgucauggaacccaucgcacaaaugauguccucacgcucaucccccgccuccauacaauuccaaaacggccgcugcacccugucuggcgaccuacuugguaccacuccauccuccccagccgaccuuggcgccuucguaggacuacgcgccgaacccggcucccacgucguugagcugucucaacccaaccaagaagacuuccaugcuggcucagcacccgccccauuuggauuccccgacuucuccgauuguucugucaccuucgucguagcgucagcaacaaucgucgaacaacgcaccguaaacgcccgcagccuccaaaacuucaccccagcccuuggccacaucacauucgacgaagaagccccagccgaucucuuccgcgcucgcuucagaaaugucugggacccaaccgaacacucauucuggcgcaucccagacuaccgcgccgacguacucggauccgacuucgcccccuccgucuccgcccccggagucggagaaacacuccuauucuucaugugcaacguaccacauuccaacggcgccaaccccaaccccugccccugccuucucccacaagaauggauaacacacuucguaucagaacgcgcagcccuccaaggagacguugcccuccucaacuacauaaaccccaacacaggacgagucucauucgaagccaaacucuacgccaacggcuuccucacugucaaccucggcgccuccgaccgcacaacccucccaguagauggcaucuuuaaauucguaagcuggguaucauucuacuaccaacucagacccgucggcaacgcuucagucggccgccgacuauaa

SEQ ID NO: 39447 - RNA, 1551 nt, Artificial Sequence
  derived and/or modified sequence opt11 from VP1__Norovirus_and/or_Norovirus-like__AY549157
augaaaaugaccgaccgugacaccguugacuccgcccccgcccucggccaaguacucccacccgaaguagaggccuccguccccguugaacccacugcuggagcccccgucgccgcacccaccgccggccaagucaaucccaucgaccccuggaucuucgccaacuucguacaagcaccccaaggcgaguucaccauaucacccaacaacaaccccggcgaaauccucuucgaacuagaacucggccccgaccuaaaccccuaccucgcccaccuaagacgcauguacaacggcuggacaggcucaaugcgcguacgaguccucuuagccggcaacgccuucuccgccggcaaaguaguagucuucugcguaccacccggcuucgacaccuccuaccucacccccagccaagccacccaauuuccccacguucucaucgacguccgcgcccccgaacccguagaaaugcccuuagaagacguccgaaacauacuauuccaucaaggccccgacucccgcaugcgacuaaugggaaugcuuuacacuccccuccgagcuaacuccggcgcagaucccuucguagucacuggucggguccuuaccugccccagccccaacuucuccuucuucuuccuaguaccacccaccguagaagagagagaacccccauucacacuccccaaccuucccgucaacaaucucucccauucacgagucauggaacccauagcccaaaugaugucuucacgcaacuuccccgccucaguacaguuccaaaacggccgccgcacccuauccggcgaccuccucggcaccacccccuccuccccagccgacuuaggcgccuucguuggccuacgcgcagaacccggcucccgcgucguagaacucucccaaccuaaccaagaagacuuccacgcaggcuccgcaccagcccccuucggcuucccagacuucucugauugcagcguuacuuucgucguagcuuccgccaccaccgucggcgagcgcaccgucaacaccagaagccuucaaaacuuuacaccagcccuaggacauaucaccuucgacgaagaagcccccgcagaccuuuucagagcacauuuccgcaaucuaugggaacccacugaacacucauucuggcgcauaccagacuaccgcgccgacguccucgguagcgauuucgcacccucagucuccgcccccggcgucggcgaaacccuccuauucuucaugugcaacgucccccgucuaaacggcgccaaccccaauccuugcccaugucuccuaccccaagaauggauaacccacuucguauccgaacgcgccgcccuacaaucagacguggcacuccuaaacuacgugaacccuaauacaggacgcguccuguucgaagcuaaacuuuacgcaaacggcuuccucaccgucaaccucggcgccucugaccaagccacccuacccgucgacggcauauuuaaguucgucuccugggucuccuucuacuaccaacuccgccccgucggcaacgccuccgucggucgcagacuauga

SEQ ID NO: 39448 - RNA, 1551 nt, Artificial Sequence
  derived and/or modified sequence opt11 from VP1__Norovirus_and/or_Norovirus-like__AY549158
augaaaaugacagaccgcgacgccgucgacucagccccagcccuuggccaaguccucccaccagaagucgaagccuccguacccgucgaacccacugccggcgcacccgucgccgcccccaccgccggccaagucaaucccaucgacccuuggauauuugcgaacuucguccaagccccacaaggagaauuuaccauauccccuaacaacaacccaggcgaaauacuauucgaacucgaacuaggucccgaccucaaccccuaccucgcacaucugcgccgcauguacaacggcuggacagguucaaugcgaguccgcguccuccucgccggaaacgccuucuccgccggcaaaguaguagucuucugcgucccacccggcuucgacaccucauaccucacccccagccaagccacacaauucccccacguccucaucgacguccgugcuccagaaccagucgaaaugccccuagaagacguccgcaacauccucuuccaccaaggccccgacucccgcaugcgccucaugggaaugcucuacacaccacuccgagccaacuccggcgccgacccauucgucgucaccggccgaguucucacaugccccucucccaacuucuccuucuucuuccuagucccucccacagucgaggagcgcgaaccacccuucacacuucccaaccuccccguuaacaaccccucacacucccgcgucauggaacccaucgcccaaaugaugucuucucgcaacuucccagccuccguccaauuccaaaacggccgaugcacacucuccggcgaccuccucggaacaacccccuccuccccagcagacuuaggugccuucgucggacuacgagccgaacccggcucacgcgucgucgaacuaucccaaccaaaccaagaagacuuucacgccggcuccgcccccgccccauucggcuuccccgacuucuccgacugcuccgucacauucgucguagcauccgccaccacagucggagaacgcacuguaaacacccgaucccuacaaaacuuuacccccgcccucggacacaucacauucgacgaagaagccccagccgaccuauuccgcgcccacuuccgcaaccucugggaacccaccgaacacuccuucuggcgaaucccugacuaccgcgcagacguacuuggcuccgacuucgcacccucagucucggcaccagguguaggugaaacccuccucuuuuucaugugcaacguccccagacuaaacggcgccaaucccaauccuugucccugccuuuuaccccaagaauggaucacccacuucgucucugaacgcgcggcucuacaauccgaugucgccuuacucaacuacgucaaccccaacaccggccgcguccucuucgaagcaaaauuauacgccaacggcucccucaccgucaaccuuggagccuccgaccaagccacacuccccguagacggaaucuucaaauuuguuuccuggguauccuucuacuaccaacucagaccagucggcaacgcguccgucggccgucgacuauga

SEQ ID NO: 39449 - RNA, 1551 nt, Artificial Sequence
  derived and/or modified sequence opt11 from VP1__Norovirus_and/or_Norovirus-like__AY549165
augaaaaugaccgaccgcgacacagucgacuccgcccccgcccucggccaaguccucccgcccgaagucgaagccucaguccccguugaaccaacagcuggcgcuccagucgccgcccccaccgccggccaagucaaccccauagaccccuggauauucgcaaacuucguccaagcaccacaaggcgaguucaccauauccccuaauaacaacccaggcgaaauccucuucgaacuagaacucggcccugacuuaaacccauaccuugcccaccuacgccgcauguacaacggauggaccggaucgaugcgcguccgaguucuccuagccggaaacgcauucucugcaggcaaaguaguggucuucugcgucccacccggcuucgacgccuccuaccucacccccucccaagccacacaguucccccacguacuuaucgacguccgagccccagaacccguagaaaugccacucgaagacguacgaaacauccucuuccaccaaggccccgacucacgaaugcgacuuaugggcaugcucuacaccccacuccgcgccaacuccggagcagaccccuucguagucaccggccgcguccucacaugccccucacccaacuuuuccuucuucuuccucggcccucccaccgucgaagaacgcgaaccccucuucacacuccccaaccuucccgucaacaaccuuucacacagccgagucauggaacccauagcacaaaugaugagcucccgcuccuuccccgcuucuguccaauuccaaaauggucgcuguacccuaagcggugaccuccuuggcaccacccccuccagccccgccgaccucggagcauucguaggccuccgcgcagaacccggcucccacgucguugaacuaucccaacccaaccaagaagacuuccacgcaggcuccgcccccgcccccuuuggcuucccagacuucuccggaugcuccguaacauucgucgucgcaucagcuaccauugucgaacaacgcaccgugaacacccgaucacuacaaaacuucaccccagcacuaggucacauaaccuucgacgaagaagccccagcagaccucuuccgagcacgauuccgcaacguuugggaccccacagaacacagcuucuggcgaaucccugacuaccgagccgauguccuagguucagacuucgccccauccgucuccgcgccaggcggcggcgaaacacuccucuucuuuauguguaaugucccacauuccaacggagccaaccccaacccaugccccugccuacucccccaagaauggauaacccacuucgucuccgaaagagccgcccuccaaggcgacgucgcccuccuaaacuacaucaaccccaacacaggccgcguacucuucgaagccaaacuguacgccaauggcuuccucaccgucaaccuaggagccagcgaccaagccgcccuaccagucgacgguauauuuaaauucguuagcuggguaaguuucuacuaccaacuccgccccguaggcaaugcauccguaggucgccgacucuaa

SEQ ID NO: 39450 - RNA, 1551 nt, Artificial Sequence
  derived and/or modified sequence opt11 from VP1__Norovirus_and/or_Norovirus-like__AY549167
augaaaaugaccgaccgcgacaccgucgacucagccccugcacucggccagguacucccucccgaggucgaagccucgguacccgucgaaccaaccgccggagcuccugucgcagcacccacagccggacaagucaacccuaucgauccauggaucuucgcuaacuucguccaagcaccccaaggggaguucacuaucagucccaacaacaaccccggagaaauacucuuugaacuugaacucggccccgaccucaacccauaccuagcacaccuccgccgaauguacaacggcuggacagguuccaugcgcguucgcguccuuuuagcuggaaacgcuuucuccgccggaaaagucgucguauucugcgucccacccggcuucgacaccuccuaccugaccccaucccaagccacccaauucccccacguccuuauagacguccgagcccccgaacccgucgaaaugccccucgaagacguccgcaacauccucuuccaccaaggacccgacucaagaaugcguuuaaugggcaugcuuuacaccccacuacgcgcuaacuccggugcugaccccuucgucgucaccggucggguccuuaccugccccucccccaacuucuccuucuucuuccucgucccaccaaccgucgaagaacgcgaaccccucuucacccuccccaaccuccccgucaacaaccucucccacucccgcguaauggaacccauagcccaaaugaugagcucccgcggcuucccugccuccguccaguuccaaaauggccggugcacacucucaggcgaccuccuuggaacaacaccaucuucccccgccgaccuaggcgccuucgucggccuacgagccgaacccggcucccacgucgucgaacucucccaacccaaucaagaagacuuccacgcaggauccgccccagcacccuucgguuuccccgacuucucagacugcucugucaccuucgucgucgcaucugcaaccaucgucgaacaacgcaccgucaaugcccgcucacuacaaaacuucaccccagcccuaggccacaucaccuuugacgaagaggcccccgccgaccuauuucgcgcccgcuuccgaaacgucugggaccccaccgaacacucuuucuggcgcauucccgacuauagagccgacguccuaggcuccgauuucgcacccuccguaucugcaccaggcgucggcgaaacccuccucuucuucaugugcaaugucccccauuccucuggagccaaccccaacccaugccccugccuacucccacaggaguggaucacccacuucguaucagaacgcgcagcacuacaaggcgacgucgcucuccucaacuacaucaacccaaacaccggccgcguccuauucgaggcaaaacucuacgccaacggauuccucaccguaaaccuaggagcuuccgaccaagcaacccuccccguagacggcaucuucaaauucgucucaugggucucuuucuacuaccaacuucgacccgucggaaacgccucagucggucgacgacuguaa

SEQ ID NO: 39451 - RNA, 1551 nt, Artificial Sequence
  derived and/or modified sequence opt11 from VP1__Norovirus_and/or_Norovirus-like__AY549154
augaaaaugacugaccgcgacaccgucgaucccgcccccgcucuaggccaaguccucccacccgaagucgaagccagcguccccguagagccuaccgccggugcacccgucgccgcgcccacagccggccaaguuaacccaaucgaccccuggaucuucgccaacuucguacaagcuccccaaggugaguucacaauaucccccaacaauaaccccggagaaauacucuucgaacuagaacucggaccagaccuuaaccccuaccuagcucacuugcgccauauguacaacgguuggacuggcuccaugcgaguccgcguccuccuagccggcaaugcuuucucagcuggcaaagucgucgucuucugcgucccgcccggcuucgacaccuccuaccuaacacccucccaagccacccaauucccccacguccuaaucgacguacgcgcccccgaaccaguugagaugccacucgaagacgucagaaacauccucuuccaccaaggcccagacucacgcaugagacuaaugggcaugcucuacacuccccuccgcgccaacucauccgcagaccccuuugucguaacaggacgcguccucacuugccccaacccaaacuucuccuucuucuuccuaguucccccuacagucgaagaacgcgaacccccuuucacccucccaaaccuaccagucaacaaccucagccacucucgcguuauggaaccaaucgcccaaaugauguccucccgaaacuuccccgccuccguccaauuucaaaacggacgcuguacucuaucuggcgaccuccuaggcaccacccccuccucaccagccgaucucggcgccuuuguaggccuucgcgccgaaccaggcucucgcgucgucgaacucucacaacccaaccaagaagauuuucacgccggcucagcccccgcccccuucggauuuccagacuucucagacugcuccguaaccuucgucgucgccuccgcaacaacuguaggcgaacgcaccgucaacacacgaagccuccaaaacuucacccccgcccuuggacacaucacuuucgacgaagaggccccagccgaccucuuccgcgcacacuuccgcaaccuaugggaaccuaccgaacauucauucuggcgcauucccgacuacagagccgacguccuaggcuccgacuucgcccccuccgucuccgcuccaggaguaggcgaaacccuccuauucuucaugugcaacguaccacgccucaacggagcaaaccccaacccaugcccuugucuccucccccaagaauggauaacccauuucgucuccgaacgcgccgcccuccaauccgacgucgcccuacucaacuacgucaacccaaauaccggccguguacucuucgaagccaaacucuacgccaacggcuuccucaccgucaaccugggcgccuccgaccaagccacccuccccgucgacgguaucuucaaauucgugagcuggguauccuucuacuaccaacuccgccccgucggcaaugcuuccguaggacgacgccucuaa

SEQ ID NO: 39452 - RNA, 1551 nt, Artificial Sequence
  derived and/or modified sequence opt11 from VP1__Norovirus_and/or_Norovirus-like__AY549155
augaaaaugaccgaccgagacacagucgacuccgcucccgcccucggccaggucuuacccccagaagucgaagcaagcguacccguagaacccaccgccggcgcacccgucgccgcuccaacagccggccaagucaaccccaucgaccccuggauauucgcuaacuucguccaagcaccccaaggcgaguucaccaucucccccaacaacaaccccggcgaaauccucuucgaacucgaacucggccccgaccuaaacccauaccucgcccaccuucgacgcgucuacaacggcuggaccggcucaaugcgagugcgcguccuccuagccggcaacgcuuucucagcaggcaaagucgucgucuucuguguaccucccggcuucgacaccuccuaccucaccccaucccaagccacacaauucccccauguccuaaucgacguccgcgcaccagaacccguugaaaugccccucgaagacguccgcaauauauuauuccaccaaggacccgacuccagaaugaaacucauggguaugcuuuacaccccacuucgugcaaacucgagcgccaaccccuucgucgucacuggacguguucuaaccugccccucccccaacuucucauucuucuuccucguucccccaacagucgaagaacgagaaccgcccuucacccuacccaaccuccccgucaauaaucugucacacucacaggucauggaaccaaucgcccaaaugaugucuucccgcaacuucccagccucgguccaauuucaaaauggccgauguacauuaucuggagaccuacucggcacuaccccaucauccccugccgaccuaggagccuucgucggccuacgcgcagaacccggcagucgcgucguagaacuaucucaaccaaaccaagaggauuuccacgcaggauccgcccccgcccccuucgguuuccccgacuucuccgacugcucugucacauucgucgucgccuccgccacaacagucggcgaacgcaccguaaacgccagaacccuacaaaacuucacccccgcccuuggacacauaaccuucgaugaagaagccccagcagaccuauuccgcgcacacuuccgaaaccuaugggaacccacagaacauuccuucuggcgcaucccagacuacagagccgacguccucggcuccgacuucgccccguccgucucugcuccuggcguaggggaaacccuccucuucuucaugugcaacgucccacgccucaacggcgcuaaucccaaccccugcccaugccuacucccccaagaauggaucacccacuuuguaucagaacgcgcggcccuacaaucugacguagcacuccuaaacuacguuaacccaaacacaggccguguacuauucgaagccaaacucuaugcuaacggcuuccuuacagucaaucuaggugccuccgaccaagccacucuccccgucgacggcauuuucaaauucgucucuugggucucauucuacuaccaacuccgcccagucggaaaugccuccgucggccgccgccucuaa

SEQ ID NO: 39453 - RNA, 1551 nt, Artificial Sequence
  derived and/or modified sequence opt11 from VP1__Norovirus_and/or_Norovirus-like__AF320625
augaaaaugaccgaccgugacaucaucgacucugcccccgcccucggccagguccuaccaccagaaguagaagccucaguuccagucgagcccaccgcuggcgcccccgucgcagcccccacagccggacaagugaacccaaucgaucccuggaucuucgcuaacuucguccaggcuccccaaggcguauucacaaucucccccaacaacaauccuggugaaauccuauuugaacuugaacuaggccccgaccucaacccuuaccucgcccaccuucgccgcauguacaacggcuggaccggcaguaugcgcguacgcguccuccucgcaggcaacgcauucucugccggaaaagucgucgucuucugcguacccccagguuucgacaccucauaccuaacccccucccaagccacucaauucccucacguccucaucgacguacgcgccccugaaccagucgagaugccccucgaagacguccgcaacauccucuuccaucaaggccccgacucccgcaugcgccucaugggaaugcuuuacacuccccuccgcgccaacuccggagccgacccuuucguaguaaccggccgcguacucacaugccccucaccaaacuucuccuucuucuuccucgucccgcccacaguagaagaaagagagcccucauucacccuccccaaccuccccguaaacaaccucucucacucaagagucauggaacccaucgcccaaaugauguccucccguaccuuccccgccuccguccaguuucaaaacggccgcugcacacuuagcggcgaccuccucggcaccacaccauccagcccauccgaccucggcgcguucguuggacuaaucgccgaacccggcucacgcaucgucgaacucucccaaccaaaucaagaagacuuccacgcaggcuccgccccugccccuuucggauucccagacuuuucagacugcucccucaccuucgucgucgcuuccgccaccaccguaggggaacgaacagucaacgcgcguucucuccaaaacuucaccccagcucucggccauaucaccuucgacgaagaggcccccgccgaccuuuuccgcgcccaccuccgcaaucuuugggaccccacugaacacucguuuuggcgcauccccgauuaccgagccgacguauuaggcuccgaguucgcacccuccgucuccgcccccggcgucggcgaaacccuccuauucuucaugugcaacgucccccgucuaaacggcgccaacccgaaccccugccccugccuucucccucaagaauggauaacccacuucgucucagaacgcgccgcccuccaauccgacgucgcccuccucaacuaugucaaccccaacacaggccgcguccuauucgaagccaaacucuacgcgaacggcuuccuuacagucaaccucggcgccuccgaucaagcaacacuccccgucgacggcaucuucaaauucguauccugggucuccuucuacuaccaacuccgaccaguuggcaacgccuccgucggucgccgacuauga

SEQ ID NO: 39454 - RNA, 1551 nt, Artificial Sequence
  derived and/or modified sequence opt11 from VP1__Norovirus_and/or_Norovirus-like__AY274820
augaaaaugaccgaccgcgacaccguagauucagcacccgcccuggggcaaguccucccacccgaggucgaagcguccguccccgucgaacccacagccggcgcacccguugccgcacccacagcaggacaagucaacccuaucgacccauggaucuucgcaaacuucguccaagcgccccauggcgaguucacaauaucccccaacaacaacccuggagaaguccucuucgaacucaaacucggcccagaccucaaccccuaccuagcccaucuacgccgcauguacaauggcuggaccggcuccaugcgcguccguguacuccucgccggaaacgccuucucugccggcaaaguaguaguguucugcguuccucccggcuucgacacauccuaccucacccccucccaagccacccaauucccccauguacucauugacguccgagcccccaaacccgucgaaaugccccuugaagacguccgcaacauccucuuccaucaaggccccgacucccguaugcgccucauggguaugcuauacacgccccuacgagcaaacagcggcgccgauccauucgucguuaccggucgaguccuaaccugccccucccccaacuucuccuucuucuuccucguacccccuacagucgaagaacgugaacccccauucacacucccuaaucuccccgucaacaaccucucccacucacgcgucauggaacccauagcacaaaugaugucaucucgcaacuucccagccuccguacaguuccaaaacggacgcugcacacucagcggugaccuacucggcaccacacccagcucccccgccgaccuaggcgccuucgucggacuccgcgcagaacccggcucccgcgucguagaacucucucaacccaaccaagaagacuuucacgcaggauccgcuccggcccccuucggcuucccagacuucuccgaaugcuccgucaccuucauggucgccuccgccaccaccguaggcgaacgaacaguaaacacccgaucacuccaaaacuucacccccgcccuaggccauaucaccuucgacgaagaagcccccgcagaccucuuccgcgcacguuuccgcaaccuaugggaacccaccgaacacagcuucuggcgcauuccagacuaccgcgcagacguccucgguucagaguucgcccccuccguuuccgcccccggagucggcgaaacucuacucuucuucauguguaacgucccacgucuaaauggcgcaaaucccaaccccugucccugccuccucccacaagaauggaucacacacuucgucuccgaacgugccgcccuucaauccgacguagcccuccucaacuacgucaacccaaacaccggccgcguucuauucgaagccaagcuauacgccaacggcuuccucaccguaaaccucggcgccucugaccaagcaucccuacccguagaugguaucuucaaauucgucuccugggucucauuuuacuaccaauuacgcccagucggcaacgccuccguaggacgacgccucuaa

SEQ ID NO: 39455 - RNA, 1551 nt, Artificial Sequence
  derived and/or modified sequence opt11 from VP1__Norovirus_and/or_Norovirus-like__AF542083
augaaaaugacagaccgcgacaccguagacuccgccccugcacuaggacaaguauuaccacccgagguagaggccuccguccccguugaacccacugcuggcgcccccguugcagcucccaccgccggccaagucaaccccauagacccauggaucuucgcaaacuucguccaagcgccccagggcgaguucacaauauccccaaacaacaaccccggcgaaguccucuucgaacuagaacuaggcccagaccucaaccccuaccuagcccaccuacgccgcauguacaacggauggaccggcucaaugcgaguccgaguccuucucgccggcaacgccuucucugccggcaaagucgucgucuucugugucccaccaggcuucgacacauccuaccucacaccuucccaagcaacccaauucccgcacguacucauagacguccgagcgccagaacccgucgaaaugccccucgaagacguccgaaacauccucuuccaccaaggccccgacucccgcaugcgccuuaugggcaugcucuacacaccccuccgcgcaaacuccggagcagaccccuucgucguuaccggccgcguccuaaccugcccauccccuaacuucuccuucuucuuccucgucccucccacggucgaagaacgcgaacccccuuucacccucccaaaccuacccguaaacaaccucucccauucccgugucauggaaccuauagcacagaugaugucuucccgcaacuuuccugccucuguccaauuucaaaacggccgcugcacucucucaggcgaccuccuaggcaccacccccuccucaccagccgaccucggcgcguucguaggccuccgagcggaacccggaucccgcgucguagaacucucccaacccaaccaggaagacuuccacgucggcuccgcccccgcaccccucgguuuccccgacuucucagacugcuccguaacauucguagucgccucugcuacaaccguaggcgaacgcacugucaacacccgcucacuacaaaacuucaccccugcccuaggacacaucacuuucgaugaagaagcccccgccgaccuuuuccgcgcccacuuccgcaaccucugggaaccuacagaacacucauucuggaggaucccagacuaccgugcagacguacucggcuccgacuucgcacccuccgucucagcccccggcgucggugaaacccuccuauuuuucauguguaacgucccgcgccuaaacggcgcuaaccccaacccaugccccugccuccucccccaagaauggaucacacacuucgucuccgaaagagcagcacuccaauccgacguagcccucuuaaacuacguaaaccccaacaccggccgcguccuuuucgaagccaaccuuuacgccaacggcuuccucacagucaaccuaggagcauccgaccaagcuacccuacccgucgacggcaucuucaaauucgucucauggguguccuucuacuaccaacuccgccccgucggaaaugcgagcgucggccgccgccucuaa

SEQ ID NO: 39456 - RNA, 1551 nt, Artificial Sequence
  derived and/or modified sequence opt11 from VP1__Norovirus_and/or_Norovirus-like__EU794907
augaaaaugacugaccgcgacgucaccgacuccgccccagcucucggccaaguccucccacccgaagucgaagcauccguccccguugaacccacagccggcgcaccugucgccgccccaacugccggccaagucaaccccaucgaccccuggaucuucgccaacuucguccaagcuccccaaggugaguucacgaucuccccaaacaacaacccuggcgaaaucuuauucgaacucgaacucggccccgaccucaaccccuaccuagcccaccuucgucgaauguacaacggauggacaggcuccaugcgcguacgaguccuucuugcuggaaacgccuucuccgccggcaaaguugucgucuucugcgucccgcccggcuucgacaccucuuaccuaacucccucucaagcaacacaauucccccacguccuaaucgacguccgcgcacccgaacccguugaaaugccccucgaagacguccguaacauccucuuccaccaaggucccgauuccagaaugcgccucaugggcaugcucuacacaccacuccgagcaaacucaggugcagaccccuucgucgucacaggacgcguccuuaccugcccaucccccaacuucuccuucuucuuccucguaccacccacagucgaggaacgcgaacccccauucacccuccccaaccuuccagucaacaaucucucacacucccgagucauggaacccaucgcccaaaugaugucgucacgcaacuuccccgccagcguccaauuccaaaacggccgcugcacccucucaggagaccuccucggcaccacuccuagcucccccucagaccucggcgcauucgucggccucauagcagaaccaggcagccgagucgucgaacucucccaacccaaccaggaagacuuucacgccggaucagcccccgccccuuuuggcuuucccgacuucucugacugcucccucacauucgucguagccuccgcaaccaccgucggagaacgaacaguaaacgcccgcucuccacaaaacuucacuccggcucucggacacauuacauucgacgaagaagcuccagccgaccuuuuccgagcccaccuacgcaaccuaugggaccccacagaacacuccuucuggcguauucccgacuaccgagccgacguuuuaggauccgaguucgcacccuccguauccgcccccggcguaggugaaacccuccuauucuucaugugcaacguaccccgccucaacggcgcaaacccgaauccaugccccugccuacuaccacaagaauggaucacucacuucgucuccgaacgcgcagcccuccaaucugacguagcccuacucaacuacgucaaccccaacacaggccgaguccucuucgaagccaaacucuacgcaaacggauuccucaccgucaaucucggcgccucagaccaggcuacacuccccgucgacggcaucuucaaauucgucuccugggucucauucuauuaccaacuccgccccgucggaaacgcauccgucggccgacgccucuag

SEQ ID NO: 39457 - RNA, 1551 nt, Artificial Sequence
  derived and/or modified sequence opt11 from VP1__Norovirus_and/or_Norovirus-like__AY126474
augaaaaugaccgaccgcgauaccaucgacuccgcccccgcccuuggccaaguccuaccacccgaagucgaagcauccguacccguugaacccacugcaggcgcccccgucgccgcacccacugccggccaagucaaccccaucgaccccuggaucuucgccaacuucguacaagcuccccaaggcgaauuuacaauaucaccuaacaacaacccaggcgaaauccuguucgaacuagaacucgguccggaccuuaaccccuaccuugcccaccuccgccgcauguacaacggcuggacaggcagcaugcgaguccguguccuucuugccggcaacgcauucuccgccggcaaagucgucguauucugcguaccuccaggcuucgauaccuccuacuuaacaccuucucaagccacacaauucccccacguccucauugacguccgcgcacccgaacccgucgaaaugccccucgaagacguccgcaacauccucuuucaccaaggccccgacagccgcaugcgacucaugggcaugcucuacacaccccuaagagccaacucaggcgccgaccccuucgucgucaccgggagaguccucaccugucccuccccuaacuucuccuucuuuuuccucgucccacccaccgucgaagaacgggaacccccauucacccuacccaaccuccccguuaacaaccugucacacucacgcguaauggaacccaucgcacaaaugauguccucacgaaacuuccccgcauccguacaauuucaaaauggccgaugcacccucuccggcgaccuacuuggcaccaccccaucaucacccgccgaccucggugcauucgucggacucauugcagaacccggcucacgcgucgucgaacugucccagcccaaccaagaagacuuccacgcaggcucagcucccgccccuuucggcuucccagacuuuucagaauguucucucaccuuuguagucgccucugcaaccaccgucggagaacguaccgucaauacaaggucacuccaaaacuucacacccgcccucggccacaucaccuucgacgaagaagcccccgccgaccucuuccgagcccacuuacgaaaccucugggacccaaccgagcacucuuucuggcgaauccccgacuaccgcgccgacguccuaggcuccgaguucgcccccuccgucuccgccccaggcgucggcgaaacccuccuauucuucaugugcaacguaccccgccucaacggcgccaauccaggacuaugccccugccuccucccccaagaauggaucacccacuucgucucugaacgugccgcccuccaauccgacgucgcacuccucaacuacgucaaccccaacaccgguaggguccucuuugaauguaaacucuacgccaacggcuuucucaccgucaaccucggagccuccgaccaagccacccucccaguagauggaauauucaaguucguaucaugggucuccuucuacuaccaacuccgucccguaggcaacgccucaguuggccgccgacuauag

SEQ ID NO: 39458 - RNA, 1551 nt, Artificial Sequence
  derived and/or modified sequence opt11 from VP1__Norovirus_and/or_Norovirus-like__JX145650
augaaaaugacugaccgcgacaucguagacuccgccccugcccuaggccaaguccucccucccgaagucgaagccuccguccccgucgaacccaccgccggcgcccccgucgcggccuccaccgccggacgcgucaaccccauagaccccuggauuuucgccaacuucguccaagcaccacaaggcgaauuuaccauuucccccaacaacaacccaggagaaauccucuucgagcuugaacucggacccgacuuaaaccccuaccucgcacaccuccgucgcauguacaacggcuggacuggcucaaugagagucagagugcuucucgccggaaacgcuuucucugcagguaaagucgucgucuucugcguuccacccggcuucgacaccucauaccucacccccucacaggccacacaauucccccacguccuaaucgacguacgagcccccgaacccgucgacaugccccuagaagauguccgaaacauauuauuccaccaaggcccagacucucgcaugcgacuuaugggcaugcucuacacaccgcuccgcgccaauuccggcgcagaucccuucgucgucaccggaagaguccuaaccugcccaucuccaaacuucuccuucuucuuccucguaccacccaccgucgaagaacgagaaccacccuucacucuccccaaccuaccagucaacucacuuucccacuccagagucauggaacccauagcacaaaugaugucaucucguuccuucccagccuccguccaauuccagaauggccgcuguacacucucaggcgaccuacucggcaccacccccucaucccccgccgaccuaggcgccuucgucggccucaucgcagaacccggcucccgcgucgucgaacucucccaaccuaaucaagaggacuuccacgccggauccgcccccgcccccuucgguuuccccgacuuuuccgaaugcuccguuaccuucgucguggccuccgccaccacaguuggcgaacgaacagucaacgcccgcaacccucaaaacuucacaccagcccuaggccacauaaccuucgacgaagaagccccagccgaccuauuccgagcccgcuuccgcaaccuuugggagcccaccgaacacucauucuggcgcaucccagacuaccgagccgacguccucggauccgacuucgccccauccgucuccgcccccggagucggugaaacccuccuauucuucaugugcaacguccccagacuuaacggugcaaaccccaaucccugucccugccuacucccacaagaauggauuacccacuucgucuccgaacgagccgcacuacaaucagacgucgcacuacucaacuacguuaaccccaacacaggccgaguccuguucgaagccaaacucuacgccaacggcuuccucacagucaaccucggcgccuccgaccaggcaauacuccccgucgacggcaucuucaaauucguuagcuggguauccuucuacuaccaacuccgccccguaggcaacaucuccgucggccgccgacucuaa

SEQ ID NO: 39459 - RNA, 1548 nt, Artificial Sequence
  derived and/or modified sequence opt11 from VP1__Norovirus_and/or_Norovirus-like__AY549161
augaaaaugaccgaccgcgacaccacagacuccgcccccgcccucggccaaguacucccuccagaagucgaagcauccguccccgucgaacccaccgccggugcccccgucgcagcagcaaccgccggccaagucaaccccaucgacccuuggaucuucgccaacuucguccaagcaccccaaggagaguucacuaucucccccaacaacaacccaggcgaaauccucuucgaauuggaacucggccccgaccucaauccauaccuagcccaccuacgccggauguacaacggauggaccggcucaaugcgcguccgcguucuccucgcuggcaacgccuucuccgccggcaaagucgucgucuucugcguaccucccggcuucgacgcaagcuaccucacaccaucccaagcuacccaauuuccacacguucucauagacguccgcgccccggaacccguagaaaugccccucgaagacgugcgcaacauccucuuccaccaaggcccagauucccgaaugaaacuaaugggaaugcucuacacuccccuacgcgccaacuccggugccgaccccuucgucguaaccggacguguccuuaccugccccucaccaaacuucuccuucuucuuccuuguacccccaaccgucgaagaacgagaagcucccuucacucuccccaaccuucccgucaacucacugucacacucucgauacgucggcccaaucaugcaaaugaugucuucccgcacauuccccgccucaguccaauuccaaaacggccgcugcacccucuccggugaccuccucggcaccacccccuccucauccgccgacuugggagcauucguaggucugaucgccgaagcagguucccgcgucgucgagcucucccaaccgaaucaagaggauuuccacgccggcucagcccccgccccacucggauucccagacuucuccgacugcucucucaccuucgucgucgccucacuuaccacagucggcgaacgaaccguaaacgcucgcucucuccaaaauuucacacccgcccuaggccacgucaccuucgacgaagaagcccccgccgaccuauuucgcgcgcgccuucgaaaccuuugggaccccacagaacacuccguauggcgcauccccgacuaccgagccgacgucuuaggcucagaguucgcacccucagucuccgcccccggcgucggcgaaacguugcucuuuuucaugugcaacguuccacaccaaaccggagcaaaccccaaccccugucccugccucuuaccucaagaauggauaacccacuucgucucugaacgcgccgcccuccaaucagaagucgcccuccucaacuacguaaaccccaacacuggccgcguccucuucgaaugcaaacucuaugcuaacgguuuccuuacaguaaaccucggcgccucagaccaagucucccuccccguagacggcauauucaaauuuguauccugggucuccuucuacuaccaacuccgccccgucggcaauaccggcguaggccgacgcuga

SEQ ID NO: 39460 - RNA, 1548 nt, Artificial Sequence
  derived and/or modified sequence opt11 from VP1__Norovirus_and/or_Norovirus-like__AY549164
augaaaaugaccgaccgugacgccgucgacagcgcgcccgcccucggccaagugcucccucccgaaguagaagccuccguucccguugaacccaccgccggugccccgguugccgcccccacagccggucaagucaauccuaucgacccuuggaucuuugccaacuucguccaagcaccccaaggugaguucacuaucucccccaacaacaaccccggcgaaauacucuucgaacuagaacugggccccgaccucaacccguaccucgcccaucuccgccguauguacaacggcuggaccggcuccaugcgcguccgcguccuccuagccggaaaugcauucuccgccggaaaaguagucgucuucugcgucccacccggcuucgacaccucauaccucacccccucccaagcuacccaauucccccacguacucauagacguucgcgccccagaaccaguagaaaugccucucgaagacguccguaacauccucuuccaccaaggucccgauuccagaaugcgccucaugggaaugcucuacaccccacuccgagccaacucuggcgccgaccccuuuguaguaacuggccgcguacuaaccugcccaucacccaauuucuccuucuucuuccucggucccccaaccguagaagaacgcgaaccccuauucacccuaccaaaccucccugucaacaaccuaucccacucccgaguaauggaacccauagcccaaaugauguccucucgcuccuucccagcauccguacaauuccaaaacggccgcugcacucucucaggcgaccuccucggcaccacccccuccucccccgcagaccucggcgcauucgucggacuacgcgccgaacccgguucccgcgucguagaacucucacaacccaaccaagaagacuuccacgcgggcuccgcccccgcucccuucggcuuuccugacuuuuccgacugcuccgucacuuuugucguagcaaacgcaacaaccguccaggaaugcacaguaaacacacgcaauccacaaaacuucacccccgcccucggccacauaaccuucgacgaagaagccccagccgaccuuuuccgcgcccgcuuccgaaaucucugggaccccaccgaacacucauucuggcgcauccccgacuaccgcgccgaaguccucggcucagacuucgccccauccgucuccgcaccaggcgucggcgaaacacuacuguucuucaugugcaacguaccccgaucuaacggcgcaaacccaaaccccugcccaugccuacuaccacaagaauggaucacccacuuugucucagaacgagccgcacuacaauccgauguagccuuacucaacuauguaaaccccaacacaggccgcguacuuuucgaagccaaacucuacgccaacggcuuccucaccguaaaucucggcgccucagaucaagccacccuccccguugacgguauuuuuaaauucguauccugggucucauucuacuaccaacuacgacccgucggcaacaccucuguaggccgccgauaa

SEQ ID NO: 39461 - RNA, 1548 nt, Artificial Sequence
  derived and/or modified sequence opt11 from VP1__Norovirus_and/or_Norovirus-like__AY126476
augaaaaugaccgaccgcgacaccguagacagcgccccagcccucggccaaguacuacccccagaagucgaagccucagucccagucgaacccacugccggcgcccccgucgccgccccaacagccggccaagucaacccgaucgacccuuggaucuucgccaacuucguacaagccccacaaggcgaguucacaaucucucccaacaacaaccccggugaaauucucuucgaacuugaacucggccccgaccuuaaccccuaccucgcccaccuacgacgcauguacaacgguuggaccggauccaugcgcguacguguccucuuagccggcaacgcauuuucugccggcaaagucgucguauucugugucccgcccggcuucgauaccuccuaccucaccccaucucaagcaacccaauucccccacguccuaauagacguccgcgcccccgaaccagucgaaaugccccucgaagacguccguaacauacucuuccaccaaggccccgacucccgaaugcgccuuauggguaugcucuauaccccacuccgagccaacuccggcgccgacccuuucguuguuacaggccgcguccuaaccugcccuucccccaauuucuccuucuucuuccucgucccacccaccguagaagaacgcgaaccacccuucacucuccccaaccuccccgugaacaaccucucacacagccgcgucauggaacccaucgcgcaaaugauguccucacgcuccuuccccgccuccguacaauuccaaaacggccgaugcacccucagcggggaccuccucggcaccacuccauccagccccgcagaccuaggagccuucgucggacuacgagccgagcccggaucccgcguagucgaacucagccaacccaaccaagaagacuuccacgcaggcuccgccccagccccauucggcuuccccgacuucuccgacugcucagucaccuucgucgucgccuccgcaacaaccguacaagaaugcaccguaaacacccgaaaccuccaaaacuucacacccgcacucggccacaucaccuucgacgaagaagccccagccgacuuauucagagcacgauuucggaaccucugggacccaaccgaacauucacuauggcguauucccgacuaccgcgccgaaguccucggcuccgacuucgcccccuccgucuccgcccccggcgucggcgaaacccuccucuucuucaugugcaacgucccacgauccaacggcgcaaacccaaaccccugcccaugccuccucccccaggaauggaucacacacuucguaucugagcgcgcagcccuacaaagcgacgucgcccuacucaacuacguuaaccccaauacuggccgcguccuauucgaagccaaacucuacgccuccggcuuccuuaccgucaacuuaggagccagcgaccaagccacccucccugucgacggaauuuucaaauucgucagcugggucuccuuuuacuaccaacuccgccccgucggcaacacuucagucggacgccgcuaa

SEQ ID NO: 39462 - RNA, 1548 nt, Artificial Sequence
  derived and/or modified sequence opt11 from VP1__Norovirus_and/or_Norovirus-like__EU794905
augaagaugacugaccgcgacaccaucgacagcgccccagcccuaggccaaguccuacccccugaaguagaagcaucaguacccgucgaaccaacagccggcgccccuguagccgcacccacagccggacaagucaacccaauagaccccuggaucuuugccaacuucguccaagcaccccaaggcgaauuuacaaucucccccaauaacaacccaggcgaaauccucuucgaacucgaacucggccccgaccucaacccauaccucgcacaccucagacgaauguacaauggcuggaccgguucuaugcguguccgaguccuucuagcaggcaacgcuuuuucugccggaaaaguagucguauucugcguaccaccaggauuugacaccuccuaucuaacccccucccaagccacacaguuuccccacguacucauagacguccgagcccccgaacccgucgaaaugccccuagaagacguccgcaacauccucuuccaucaaggacccgacucacgcaugcgccucauggggauguuauacaccccacuccgcgcuaacuccggagcagaccccuucguuguaacaggacguguacuaaccugucccucacccaacuuuucuuucuucuuccucgucccacccaccgucgaagaacgagaaacccccuucaccuuacccaaccuccccguaaacucucuaucccacucccgagcaauggaaccuauugcccaaaugauguccucccgcaacuucccagccuccguccaauuccaaaacggacgcugcacccuuucaggagaccuccuuggcacaacccccuccagccccgccgaugucggcaccuucgucggccuaaucgccgaacccggcucccacgucgucgaacucucccaacccaaccaagaagacuuccacgcaggcucugcccccgccccauucggauuucccgacuucucagacugcucccucaccuucguagucgccuccgccuccaccgucggugaacgcaccgucaacacucggucgccccaaaacuucaccccagcacuaggccacaucacauucgacgaagaagcuccagccgaccuauuccgcgcccaccuccgcaaccucugggacccaaccgaacauucauucuggagaaucccugacuaccgcgccgacguccucgguggagaguucgcucccucaguaucagcacccggcgucggcgaaacccuucucuucuucaugugcaacgucccccgcuccaauggcgccaacccaaaccccugucccugccuccuuccccaagaauggaucacccacuucguaucagaacgcgccgcccuccaaucagacgucgcccuccuaaacuacauaaaucccaacaccggccgcguccucuucgaaugcaaacucuacgccaacggcuuccucaccgucaaccuaggcgcguccgaccaagcaacacucccagucgacggcaucuucaaauucguauccuggguauccuucuacuaucaacugcgccccgucgguaacaucggcgucggccgccgcuag

SEQ ID NO: 39463 - RNA, 1548 nt, Artificial Sequence
  derived and/or modified sequence opt11 from VP1__Norovirus_and/or_Norovirus-like__EU794906
augaaaaugaccgaccgagacaccaucgacuccgcacccgcccuaggacaaguccucccacccgaagucgaagccucaguccccgucgaacccaccgccggcgcccccgucgcagcccccaccgcgggccaggucaaccccauagaccccuggaucuucgccaacuucguccaagcuccccaaggagaguucaccaucucccccaauaacaacccuggcgaaauccuguucgaacucgaacuaggccccgaccucaauccuuaccuagcccaccuacgccgcauguacaacggcuggaccggcuccaugcguguacgcguacuucuagccggcaacgccuucagcgccggaaaagucguagucuuuugugucccuccuggcuucgacaccucauaccuaacacccucccaagccacucaauucccccacguucucauagacguccgcgcucccgaaccagucgaaaugccccucgaagauguccgaaacauacucuuccaccaaggccccgacucccgaaugcgccugaugggcaugcuauacaccccacuccgcgcuaacucuggagcugacccuuuugucgucaccggccgugucuuaaccugccccucccccaacuucucuuucuucuuccucgucccaccaaccgucgaagaaagagaaacccccuucacucuccccaaccuaccugucaacucccucucccauuccagagucauggaacccaucgcacaaaugaugucaucccgaaacuuccccgcuagcguccaauuccagaacggaagaugcacccucucuggcgaccuccucggcaccacccccuccucccccgccgaccucggcacguuugucggccucauagcagaacccggcucucacgucgccgaacugucccaacccaaccaagaagacuuccacgcagguucugccccagcacccuucggcuuccccgacuucuccgaaugcucacuaaccuuugucgucgccucagccucuaccgucggagaacgcacagucaacacucguucccugcaaaacuucacccccgcccucggucacaucacuuucgacgaagaagcccccgcagaccuauuccgcgcccaccuucgcaaccucugggaccccacugagcacucauucuggcgcauucccgacuaccgagcugacguacuaggcggcgaguucgccccaucaguaucagcacccggcgucggcgaaacacuacucuucuucauguguaacgucccacgcuuaaacggcgcaaauccaaacccaugccccugccuccucccccaggaauggaucacacauuucgucuccgaacgcgccgcccuccagucagacguugcacuccucaacuacauaaauccaaacacuggucggguucuuuuugaaugcaaauuauacguaaacggauuccucaccguuaaccucggagccuccgaucaagccacacucccuguagacggcaucuucaaauucguaucaugggucuccuucuacuaccaacuccgccccguaggcaacaucggcguuggcagacgauaa

SEQ ID NO: 39464 - RNA, 1548 nt, Artificial Sequence
  derived and/or modified sequence opt11 from VP1__Norovirus_and/or_Norovirus-like__AY126475
augaaaaugaccgaccgugacaccgcagacccagccccagcccuaggccaaguccucccaccagaagucgaagcaucaguccccguagaaccaacagccggcgcccccgucgcagcccccaccgccggacaagucaacccuaucgaccccuggaucuucgccaacuucguccaagccccacaaggcgaguucaccaucucccccaacaauaaucccggcgaaauccucuucgaacucgaacuuggcccagaccuaaaccccuacuuagcccaccuccgacgcauguacaacggcuggacuggcuccaugcgcgucagaguacuccuggccgguaaugccuucucagccggcaaaguagucgucuuuugcgucccuccaggcuucgacacauccuaccuuacccccucccaagccacccaauucccacacguccuaaucgacgucagaguacccgaacccgucgaaaugccacuugaagacguccgcaacauacucuuccaccaaggccccgauucccgaaugcgacucauggguaugcucuauaccccacuccgcgcuaacucaggcgccgaccccuucgucgucaccggacguguccuaaccugccccucccccaacuucuccuucuucuuccucgucccacccaccgucgaagaacgcgaaccucccuucacucuucccaaccuuccagucaacaaccucucacacucccgcgucauggaacccaucgcccaaaugauguccucccgcuccuuccccgcauccguccaauuccagaacggccgcuguacccuauccggcgaccuucucggaaccacucccuccucacccgcagaccucggcgccuucgucggucuuauagcagaaccaggaucacgcgucgucgaacucuuccaaccaaaucaagaagacuuccacgccggcucagcccccgcccccuucggcuucccagacuuuuccgaaugcucuguaaccuucgucgucuccuccgccaccacugucggcgaaagaaccgucaacgcccgcaaucaacaaaacuucacccccgcccucggccacaucaccuuugaugaagaagcccccgccgaccucuuccgcgccugcuuccgcaaccucugggaacccacagaacacucuuucuggcguaucccagauuacagagcugacguacucgguuccgacuucgcacccuccgucucugcccccggcgucggagaaacccuacuauucuucaugugcaacgucccccgccugaacggagucaaccccgguccaugccccugccuccuuccacaagaauggaucacccacuucgucucagaacgagcugcccuccaauccgacgucgcucuccuuaacuacgucaaccccaauaccggacgaguacuuuucgaggccaaacuauacgcaaacggcuuccucaccgucaaccucggagcauccgaccaagccacccuaccaguagacggcauauucaaauucgucagcugggucuccuucuacuaccaacuccgaccagucggcaacacgucugucgguagacgauaa

SEQ ID NO: 39465 - RNA, 1548 nt, Artificial Sequence
  derived and/or modified sequence opt11 from VP1__Norovirus_and/or_Norovirus-like__AF542084
augaaaaugaccgaccgcgacacagucgacucagccccagcccuaggccaaguacucccacccgaagucgaagccuccguucccgucgaacccaccgccggcgccccagucgccgccccaacagcaggacaagucaaccccauugaccccuggauuuucgcaaacuucguccaagcuccccaaggcgaguucaccaucucccccaacaacaaccccggcgaaauacuauuugaacuagaacucggacccgaccuaaaucccuaccuugcccaccuccgacgaauguacaacgguuggaccggauccaugcgaguacgcguccuacucgccggcaacgccuuuucugccggcaaagucgucgucuucugcguaccucccggcuucgacaccuccuaccucacccccucacaagccacccaguucccccacguccucauagacguacgcgcccccgaacccguagaaaugcccuuagaagacguuagaaacauccucuuccaccaaggccccgacucccguaugcgcuuaaugggcauguuauauacacccuuacgcgcaaacuccggcgccgacccauucgucgucacuggccgcgucuuaaccugccccucccccaacuucuccuucuucuuccucgucccaccaaccguagaagaacgagaaccccucuuuacccuccccaaccuccccgucaauaaccucucccacucccgcgucauggaaccaaucgcccaaaugaugucaucucgaaacuucccagccuccguccaauuccaaaacggacgcugcacucucuccggcgaccuucuuggcacaacacccucauccccugcagaccuaggcgccuucguaggccuccgcgccgaacccggcucccgcgucguagaacuuucccaaccuaaccaagaggauuuccacgccggcuccgcacccgcaccccucggcuuccccgauuucucagacuguuccgucacauucgucguugccaacgccaccacuguccaagaaugcacaguuaacacccgcaacccacaaaacuucacacccgcccucggccacaucaccuucgaugaagaggcccccgccgaccucuuccgcgcccacuuucguaaccucugggaccccaccgaacacuccuucuggcgcauccccgauuaccgagccgaaguccucggauccgacuucgcacccuccguaagcgccccuggaguaggagaaacccuccucuucuucaugugcaacgucccccgcuccaacggcgcaaaccccaacccaugcccuugccugcucccacaagaauggaucacacacuucguaucugaacgcgcagcacuccaaucagacguugcccuacucaacuaugucaaccccaacacuggccgcguccuauuugaagcaaaacucuacgcuaacggcuuccugaccgucaaccucggcgccuccgaccaagcuacacuacccguagacggaauauuuaaauucgucucaugggucuccuucuauuaccaacugcgacccguaggcaacaccagcguaggacgccgauaa

SEQ ID NO: 39466 - RNA, 1536 nt, Artificial Sequence
  derived and/or modified sequence opt11 from VP1__Norovirus_and/or_Norovirus-like__KC695807
auggcccucgagcccguagucggcgccgccaucgcugcccccgucgcaggacaacaaaacguuauagaccccuggauccgcaacaacuucguccaagcccccggcggcgaauuuaccgucucaccccgaaacgcccccggcgaaauacucugguccgcaccacuaggacccgaccucaaccccuaucucucccaccucgcccgcauguacaacggcuacgcaggcggauucgagguccaagucauccucgccggcaacgcauucacagccgguaaaguaaucuucgccgccguaccucccaacuuccccaccgaaggccuaucccccucccaaguaaccauguucccacacaucgucgucgauguccgccaacucgaacccguacuaauaccccuccccgacguccgcaacaacuucuaccacuauaaccaauccaacgaccccaccaucaaacuuaucgccaugcuauacacaccccuccgugcaaacaacgccggugacgacgucuucaccguauccugccguguauuaacccgacccagccccgacuucgacuucaucuuccuugucccacccacaguagaaucgcguacuaaacccuucucaguaccuguccuuaccgucgaagaaaugaccaacagucgcuuccccauuccucuugaaaaacuauucaccggacccagcuccgcauucguaguccaaccacaaaacggccgcuguaccaccgacggcguccuccucggcacaacccaacucucacccguaaacaucugcacauuucgcggagacguaacccauauuaccggcucccgcaauuacacaaugaaccucgccucccaaaacuggaacaacuacgaccccaccgaagaaaucccagcaccccucggcgccccagacuucgucggcaaaauccaaggcaugcucacacagacaacucgagcagacgguucaacacgcggccacaaagccaccgucuacacaggaagcgccgacuucgcccccaaacugggccgcguccaauucgaaacagacacugaucacgacuucgaagcaaaccaaaacaccaaauucaccccagucggcguaauacaagauggcucaacaacacaccgcaacgaaccacaacaauggguccugccauccuauuccggccgcaacacacauaacgugcaccucgcccccgccgucgcaccaaccuucccaggcgaacaacuccucuucuuccgcucaacuaugcccggcugcuccggcuacccaaacauggaccucgacugccuacucccccaagaauggguccaauauuucuaccaagaagccgccccagcccaauccgacgucgcccuccuccgauuugucaacccagacacuggccgaguauuauucgaaugcaaacuacacaaauccggcuacguaaccgucgcccacaccgggcaacacgaccucgucaucccacccaauggcuacuuucgauucgacucauggguaaaccaauucuacacacucgcacccaugggcaacggaaccggcagacgauaa

SEQ ID NO: 39467 - RNA, 807 nt, Artificial Sequence
  derived and/or modified sequence opt11 from VP2_capsid_protein__Norovirus__AGL98415
auggcaggcgcauucuucgccggacucgcaagcgacguccucggcucaggccuaggcucacucaucaacgcaggcgccggcgcaaucaaccaaaaagucgaauucgaaaacaaccgcaagcuccagcaagcgagcuuccaauucagcuccaaccuacaacaagccucauuccaacacgacaaagaaaugcuacaagcacaaauagacgcaacccacaaacuacaacaaggccucaugcaaaucaaacaagcaguccuccucgaaggaggauucuccgccgcagacgcagcccgaggcgcaaucaacgccccaaugaccaaagcccuagacuggucgggaacccgcuacugggcacccgaagccagagucacaaccuacaacgcaggacacuucucacccucgcaaccgagcagagcccccagcggacgcauaaacucaggcacacccacgcccgcacgaaacagccucaacucgcccgcaaccucaagcguagccacaagcgugcacuccaaccaaaccgcgagcacacgcauaggcucaagcgcaggcucaggcacaagcguaagcucacucccaagcacaagccgaacccgaaacugggucgaagaccaaaacaggagcguaagcccauucaugcgcggagcccuaaacacgagcuucguaacccccccaagcucaagaucaagcaaccaauccaccguaagcacgguaccgaaagaaauacuagacucauggacaggagccuucaacacaaggcgacaaccccuauucgcacacauccgcagacgcggagaaucacgaguauga

SEQ ID NO: 39468 - RNA, 792 nt, Artificial Sequence
  derived and/or modified sequence opt11 from VP2_capsid_protein__Norovirus__AGL98417
auggcaggcgccuucuucgcaggccucgccuccgacguccucggcaccggccuuggcucccuaauaggcgccggcgccggagccauaaaccaaaaagucgaauacgaaaacaacagaaaacuccaacaagcaucauuccaauucagcuccgaccuacaacaagccagcuuccaacacgacaaagacaugcuccaggcccaaaucaaagccacccaaaaacuccaacacgaccucaugcgcgucaaacaagccguccuacuagaaggcggcuucucucccaccgacgccgcccguggcgccauaaacgcccccaugacaaaaguccuagacugguccggcacccgcuacugggcccccggcgcccgggucaccaccucuaacgccggacaauucuccuucucccaacccauccgcgaaccaucaggacgcaccgcacccgcccgaagccccgccaaccgcgccuccuccguaucagcccccucauccacccucuccaaccaaacuacuucaacacgacucggcaccuccgccggcuccggcgcauccgucucuggcuccuccuccgccucacgaguccgauccugggucgaaggacaaaaccgcucucucuccccauucauggacggcgcccuucacaccucuuucgucacacccccauccuccaaauccuccucccaaggcaccgucuccaccguccccaaagaaguccucgacuccuggaccggcgccuucaacacacaccgccaaccccucuucgcacacguacgccgccaaggcgaaucacgcguauaa

SEQ ID NO: 39469 - RNA, 648 nt, Artificial Sequence
  derived and/or modified sequence opt11 from capsid_protein_VP2__Norovirus__AFI08232
auggcccaagccguccucggcgccaucgccgcuaccgcagccgguuccgcagucggcgccggaauccaagccggcaccgaagccgcccuacaacaccaacgcuuccaacaagaccuaacccuccaauccaacacauucaaacacgacaaagaaaugcucgccaugcaagucgaagccucaacaucccuacuacaaaacucccucaacacccgcuacaaccuacucacccaagcaggccucaccuccgccgacgccgcccgagccgucgccggcgcccccgucacccgcgucgucgacuggaacggaacccgaaucgccgcaccccucuccaccgccaccacccuacgcuccggcggcuucauguccauccccgucauguaccgcggcgccaaaaccgaacaacaaaaacuaaccggcuucuccaaccccaacuacgaaaccggcucaucugucucccgaaccucccaaugggucucaucccaaaacuccaugcgcuccucagucgcccccuuccaccccgaugcccuccgaaccaccuggguaaccccacccggcuccuccuccaccuccaccgucuccuccgccucaucaaucccccgcuucuucaacaccgaacgccucccccucuucgccaacaacaaacgcuaa

SEQ ID NO: 39470 - RNA, 807 nt, Artificial Sequence
  derived and/or modified sequence opt11 from capsid_protein_VP2__Norovirus__AFI08235
auggccggagcguucuucgccggacucgcaagcgacguacuaggcuccggccugggaucccucauaaacgcaggcgccggcgccauaaaccaaaaaaucgacuucgaaaacaaccgcaaacuacaacaagccagcuuccaauucagcucgaaccuccaacaggccucauuccaacacgacaaagaaaugcuacaagcccaaauagaagcaaccaaaaaacuacaacaagaaaugaugaaagucaaacaagcaaugcuacucgaaggcggauucucggaaacagacgccgcccgcggcgcaaucaacgccccgaugaccaaagcacucgacugguccggcacacgcuacugggcacccgacgccaggaccacaacauacaacgcaggcagauucucaaccccccaaccaagcggagcccuacccggacgcauaaacccccgcacacccacaccagcacgcggcagcucaagcaccagcucaaacgccagcacagccacaagcauacacucaaaccaaaccgucagcacccgccuaggcucaaccgcaggcuccggcacaaacgugagcucacucccaagcacagccagaacccgaagcuggguagaagaccaaaacagaaaccuauccccauucaugcgcggagcccacaacaucagcuucgucaccccccccagcucaagaucaagcucacaaggaaccgucagcacagucccaaaagaaguacuaaacucauggaccggcgcguucaacacccggcgccaaccccuauucgcacacauacgcagacaaggagaaucacgcguauaa

SEQ ID NO: 39471 - RNA, 807 nt, Artificial Sequence
  derived and/or modified sequence opt11 from capsid_protein_VP2__Norovirus__AFI08238
auggcgggcgcauucuucgccgggcucgcaagcgacguacuaggcucaggccugggcucacucauaaacgcgggcgcaggcgcgaucaaccaaaagaucgacuucgaaaacaaccgcaagcuacagcaagcgagcuuccaauucuccucaaaccugcaacaggccucauuccagcacgacaaagagaugcuccaagcacaaauagaagcgacaaagaaauuacaacaggaaaugaugaaagucaagcaagcaaugcuacucgaaggcggauucucagaaacggacgcggccagaggcgcaaucaacgccccaaugacgaaaguacuugacuggucaggaacgcgauacugggcgcccgacgcccggaccacgaccuacaacgcaggcagguucucaaccccacaaccgagcggaacacuacccgggcgcaucaacccacgaacacccacgcccgcgcgcggaagcucaagcaccaguucaaacgcaagcacggccacgagcauacacucaaaccaaaccgugagcacacgccuaggaucgaccgcgggcucgggcgcgaacgugagcucacucccgagcacagccaggaccagaagcugggucgaagaccaaaacagaaaccuguccccauucaugcgcggggcccacaacaucagcuucgucacgccaccauccucacgcuccagcucgcaaggaaccguaagcacagucccgaaagagguacuagacucaugggcaggagcguucaacacaaggcgccagccccuauucgcgcacauacgcagacgaggggaaucgcgagucuga

SEQ ID NO: 39472 - RNA, 807 nt, Artificial Sequence
  derived and/or modified sequence opt11 from capsid_protein_VP2__Norovirus__AFI08241
auggcaggcgcauucuucgccggacucgcaagcgacguacuaggcucgggccuaggcucacucauaaacgcaggcgccggcgcaauaaaccaaaagaucgacuucgaaaacaaccgcaagcuccaacaagccucauuccaauucucaucaaaccuccaacaagcauccuuccaacacgacaaagaaaugcuacaagcccaaauagaagcaaccaagaaacuccaacaagaaaugaugaaagucaaacaagcaaugcuacuugaaggcggcuucucagaaacagacgcagcccgaggcgcaaucaacgcccccaugacaaaaguccuagacuggucaggcacccgcuacugggcccccgacgcccgcaccaccaccuacaacgccggccgauucuccaccccacaaccaagcggaacccuacccggacgcaccaacccacgcacccccacccccgcccgcggaagcucauccgccagcucaaacgccagcacggccaccuccauccucuccaaccagaccgccagcacacgccucggcuccacagcaggcuccggaacaaacgucagcucacuccccagcaccgcccgaaccagaagcugggucgaagaccaaaacagaaaccuaagcccauucaugcgcggagcccacaacaucagcuucgucaccccaccaagcucacgcucaagcucccaaggaaccguaagcacaguccccaaagaaguccuggacucauggacaggagccuucaacacccgccgccaaccccuauucgcacacauacgcagacgaggagaaucacgcguauaa

SEQ ID NO: 39473 - RNA, 807 nt, Artificial Sequence
  derived and/or modified sequence opt11 from capsid_protein_VP2__Norovirus__AFI08244
auggccggcgccuucuucgccggacucgccuccgacguccucggcuccggccucggcucacucauaaacgccggcgccggcgccaucaaccaaaaaauugacuucgaaaacaaccgaaaacuccaacaagccuccuuccaauucuccuccaaccuccaacaagccuccuuccaacacgacaaagaaaugcuacaagcccaaaucgaagccaccaaaaaacuccaacaagaaaugaugaaagucaaacaagcaaugcuacucgaaggcggcuucuccgaaaccgacgcagcccgcggcgccaucaacgccccuaugaccaaaguccuagacuggucuggcacacgcuacugggcacccgacgcccgcaccacaacccacaacgccggccgcuucucaacuccccaaccaucaggcacccuccccggccgcauaaacccccgcacccccaccccagcccgcggauccuccaacaccucauccaacgcuuccaccgcaaccucaauccacucaaaccaaaccgucagcacccgccucggcuccaccgccggcuccggcaccaacgucuccucccuccccucaaccgcccgaacccgcagcuggguugaagaccaaaaccgcaaccuuuccccauucaugcgaggcgcccacaacaucuccuucgucacccccccauccucacgcucauccucucaaggcaccgucuccaccguccccaaagaaguccucgacuccuggaccggcgccuucaacacccgccgacaaccccucuucgcacacauccgccgccguggcgaaucccgagucuaa

SEQ ID NO: 39474 - RNA, 807 nt, Artificial Sequence
  derived and/or modified sequence opt11 from capsid_protein_VP2__Norovirus__AFJ38520
auggccggccccuucuucgccggucuagccuccgacguccuaggaucaggccucggcucccucaucaacgcaggcgccggcgccaucaaccaaaaagucgaauucgaaaacaaccgcaaacuccaacaagcauccuuccaauucucaucaaaccuacaacaagccuccuuccaacacgacaaagaaaugcuacaagcacaaauagaagccacccaaaaacuacaacaaggccucaugaaagucaaacaagcaguccuccucgaaggcggcuucucaaccacagacgccgcccgcggcgccaucaacgcacccaugaccaaagcccucgacuggucaggcacccgcuacugggcccccgacgcccgcgcaacaaccuacaacgccggccgcuucucaacaccucaaccccucggcgcccuccccggacgcauaaacccccgcgucccagcccccgcacgcucaucccccagcucccucuccaacgcccccacggcaacaagcgucuacuccaaccagaccguauccaccagacucggcuccucagccggcucaggcgccggcgucagcucacuaccauccaccgcacgcacccggagcugggucgaagaccaaaacagaaaccucagcccauucaugcgcggcgcccuaaacaccuccuucgucaccccucccuccucccgcuccuccaaccaaggcaccgucuccacaguacccaaagaaauccuagacuccuggacaggcgccuucaacacccgacgccaaccccuauucgcacacauacgcaaacgcggcgaaucccgagucuaa

SEQ ID NO: 39475 - RNA, 765 nt, Artificial Sequence
  derived and/or modified sequence opt11 from capsid_protein_VP2__Norovirus__AFX71657
auggcaggcgccuucaucgccggccucgccggcgacaugcucaccuccaccgucggcucccucgucaacgccggcgccuccgccaucaaccagaaagucgacuucgaaaacaacaaauaccuacaaaacgccuccuucaaccacgacaaagaaaugcucaacgcccaaaucgaagccacuaaacgucuccaagccgacaugaucgccaucaaacaaggaguccucaccgccggcggcuucucccccacagacgccgcccgcggcgccauaaacgcccccaucacccgcguccucgacugguccggcacccgcuacugggccccaaacgcuaccuccacaaccuccaugucaggcggauucaccucccaaaccguccaccgcaccacccccaacuucaaaaccaaccaagcacccaaaucaacacccuccuccggcuccucaguacgcucaaacucaacccaacucaccucccucuccucccacuccuccggcuccucccgauccuccggauccaccgucgucucaucccuaccaucauccaacagaacacgcgacugggucaaccaacaaaacuucaaccucgaaccccacaugcccggcucccuccgcaccgccuuuguaaccccacccuccuccacugcauccaacucugacacuguaucuacaguccccaaauccguccucgacuccuggaccuccgccuucaacacacgccgacaaccccuuuuugcccaccuacgccgccgcggcgaauccaacgucuaa

SEQ ID NO: 39476 - RNA, 780 nt, Artificial Sequence
  derived and/or modified sequence opt11 from capsid_protein_VP2__Norovirus__AFX71660
auggccggcgccuucguugcuggccucgccggcgacguccucuccaacggccucucaucccucauaaacgccggcgccaacgccaucaaccaacgcgccgaauucgacuucaaccaacgacuccaacaaaacuccuucaaccacgacaaagaaaugcuacaagcccaaauccaagccaccaaacaacuacaagccgacaugauggccaucaaacaaggcguccuaaccgccggcggcuucucccccacagacgccgccagaggcgccgucaacgcccccaugacacaagcccuagacuggaacggcaccagauacugggcccccggaucaaugcgcaccaccuccuacucaggccgauucaccuccaccgcccccgcccgacaagccgacuuccaacacacacaaaaccgcccauccuccggaucaucagucuccuccuacaccacccaauccuccagacccacccuuaccaccacuaccggcuccucccacggcaccaccuccuccaacuccacccgcucaaccaaccucucccaaucuaccgucucccgcgccaccucacgcacauccgaauggguccgcgaccaaaaccgcaaccuugaacccuacaugcacggagcccuccaaacagcauucgucacccccccauccucccgcgccuccgacggcaccgucuccaccguuccaaaaggcguccucgacucauggaccccagcauucaacacccgccgacaaccccucuucgcccaccuccgaaaacgcggagaauccagagucuaa

SEQ ID NO: 39477 - RNA, 780 nt, Artificial Sequence
  derived and/or modified sequence opt11 from capsid_protein_VP2__Norovirus__AFX71666
auggccggcgccuucuucgccggccucgccggcgacguagucuccaacggcauaggcucccucauaaacgccggcgccaacgccgucaaccaaaaagucgaauacgacuucaacaaacaacuccaaauggccuccuucaaacacgacaaagaaaugcuccaaucccaaguccucgccaccaaacaacuucaacaagaaaugaugaacauccgccaaggcguccucaccgcaggaggcuuuucccccgccgacgcagcccgcggugccgucaacgcccccaugaccaaaauccucgacuggaacggcacccgcuacugggcccccaacuccaugaaaaccacauccuacuccggccaauucuccuccucccccguccaccgcccacccgccgcaccccaacacaccgccccucccaaauccaaacuccaaggcgacuccgucucagucuacuccucccccuccaccgucagcucacaauccacccacucaaccguccucuccgccggcaccggcuccucccgaucaacauccaccuccacagccgccuccacccuaucccgaaccuccgacuggguccgcggccaaaacgaacgccuuucccccuucauggacggcgcccuccaaaccaccuucgucaccccacccuccuccaaagccuccuccaacggcaccguuuccacuguccccaaagccguccucgacucauggacccccaccuuuaacacccaccgccaaccccucuucgcccaccuacgcagacgcggagaaucccaaaucuaa

SEQ ID NO: 39478 - RNA, 807 nt, Artificial Sequence
  derived and/or modified sequence opt11 from capsid_protein_VP2__Norovirus__AFX71669
auggcaggcgcauucuucgccggacucgcaagcgacguccuaggcucaggccuaggcucacucauaaacgcaggcgcaggcgucauaaaccaaaaggucgacuucgaaaacaaccgcaaacuacaacaagccagcuuccaauucagcuccaaccaacaacaagcaucauuccaacacgacaaagagaugcuacaagcacaaauagaagcaaccaagaaacuacaacaagaaaugaugaggguaaaacaagcaaugcuacucgaaggcggauucucagaaacggacgcagccagaggcgcaaucaacgccccaaugaccaaagcacucgacuggucaggcacaagauacugggcacccgacgcccgaaccacaaccuacaacgccggcagauucucaaccccacaaccaagcggagccucacccggccgcgccaaccuacgcgcaaccguacccgcacgcgggagcucaagcacaagcucgaacucgagcauagccacaagcguauacucaaaccaaaccacaagcacccgacucggauccacagccggcuccggcacguccgucagcucgcuccccagcacagccagaaccauguccugggucgaagaccaaaacagaaaccuaagcccauucaugcgcggcgcccacaacaucagcuucgucaccccgcccagcucaagauccagcucacaaggaaccguaagcacaguccccaaagaaguccuagacucguggacaggcgcauucaacaccagacgacaaccccuauucgcacacauacgaaaacgcggcgaaucacgcguauaa

SEQ ID NO: 39479 - RNA, 807 nt, Artificial Sequence
  derived and/or modified sequence opt11 from capsid_protein_VP2__Norovirus__AFX81122
auggccggcgccuucuucgccggccucgcauccgacguccucggcucaggccucggaucccucaucaacgccggagccggcgccaucaaccaaaaaaucgacuucgaaaacaaccgcaaacuacaacaagcauccuuccaauucuccucaaaccuccaacaggccucauuccaacacgacaaagaaaugcuccaagcacaaaucgaagccaccaaaaaacuccaacaagaaaugaugaaagucaaacaagccaugcuccucgagggcggauucuccgaaaccgacgccgccagaggcgccaucaacgccccaaugaccaaaguacucgacuggucaggcacccgcuacugggcaccagacgcccguaccaccaccuacaacgccggcagauucucuaccccucaacccuccggcacccugcccggccgcaccaacccccgcacccccacacccgcccgcggaucauccucaaccaguucaaacgccuccacagccacaucaauacucucaaaccaaaccgccagcacacgccuuggcucaaccgccggaucaggcaccaacgucucaucacuccccuccaccgcccgcacccgauccuggguagaagaccaaaaccgaaaccucucccccuucaugcgcggcgcccacaacaucuccuucguaaccccccccuccucccgcucguccucacaaggcaccgucuccaccguccccaaagaaguccuagacuccuggacaggcgccuucaacacaagacgacaaccccuauucgcccacauccgcagacgcggcgaaucacgcgucuaa

SEQ ID NO: 39480 - RNA, 807 nt, Artificial Sequence
  derived and/or modified sequence opt11 from capsid_protein_VP2__Norovirus__AFX81125
auggcaggcgccuucuucgccggccucgccuccgacguccucggaucaggccucggaucccucaucaacgccggagccggcgccaucaaccaaaagaucgacuuugaaaacaaccgcaaacuccaacaagccuccuuccaauucucuucaaaccuucaacaagccuccuuccaacacgacaaagaaauguuacaagcccaaaucgaagccaccaaaaaacuacaacaagaaaucaugaaagcaaaacaagccaugcuccucgagggcggcuucuccgaaacagacgccgcccgcggcgccaucaacgcccccaugaccaaaguccuagacugguccggcacccgauacugggcacccgacgcccgaaccgcuaccuacaacgccggccgcuucucaaccccccaaccauccggcacccuacccggccgcauaaacccccgcacccccacccccgcacgcggauccuccuccaccuccuccaacgcauccaccgccacauccauccacuccaaccaaaccgucuccacacgccuaggcuccaccgccggcucaggcaccaacgucucaucccucccauccaccgcccgcacccgcuccuggguagaagaccaaaaccgcaaccuuagccccuuuaugcgaggagcccacaacauauccuucguaaccccccccucaucacgcucauccucccaaggcaccgucuccacagucccaaaagaaguacucgacucuuggaccggcgcauucaacacccgccgacaaccccuauucgcccacauacgcagacgcggcgaaucacgcgucuaa

SEQ ID NO: 39481 - RNA, 807 nt, Artificial Sequence
  derived and/or modified sequence opt11 from capsid_protein_VP2__Norovirus__AFX81131
auggcaggcgcauucuucgccggacucgcaagcgacguacucggcuccggccuaggcucccucauaaacgcaggcgccggcgcaaucaaccaaaaaaucgacuucgaaaacaaccgcaaacuccaacaagcaagcuuccaauucagcucaaaccugcaacaggccucguuccaacacgacaaagaaaugcugcaagcacaaaucgaagcgaccaaaaaacuccaacaagaagucaugaaaguaaaacaagcaaugcuacucgaaggcggguucucggaaacagacgcagccagaggcgcaaucaaugccccgaugacgaaaguacucgacugguccggcacgcgcuacugggcacccgacgccaggaccacgaccuauaacgcaggcagauucucaaccccgcaaccaagcggaacccugcccggacgcaucaacccacgaacacccacacccgcacgcggauccucaaguacaaguuccaacgcaagcacagccacaagcauacacucgaaccaaaccguaagcacacgccuaggcucaaccgcuggcucaggcacaaacguaagcucacuaccauccacagccagaaccagauccuggguugaagaccaaaacagaaaucuaagcccauucaugcgcggagcccacaacaucagcuucguaacacccccaagcucacgcucgagcucacaaggaacaguaagcacaguccccaaagaaguccuagacucauggacgggcgcauucaacaccagacgccaaccccuauucgcacacauacgccgacgaggagaaucccgcguauaa

SEQ ID NO: 39482 - RNA, 807 nt, Artificial Sequence
  derived and/or modified sequence opt11 from capsid_protein_VP2__Norovirus__AFX81134
auggcaggcgcauucuucgccgggcucgccagcgacguccuaggcuccggccucggcucccucauaaacgcaggagcaggcgcaaucaaccaaaagaucgacuucgaaaacaaccgcaaacuccaacaagccagcuuccaauuuagcucaaaccuccaacaagcaucauuccaacacgacaaagaaaugcugcaagcacaaauagaagcaaccaagaaacugcaacaagaaaugaugaaagucaagcaagcaaugcugcucgaaggcggcuucuccgaaacagacgcagcacggggcgcaaucaacgccccaaugacaaaaguccuagacuggucaggcacacgcuacugggcacccgacgcccgaaccaccacauacaacgcaggcagauucuccaccccacaaccauccggaacccugcccgggcgaaucaacccacgcacaccaacacccgcacgcggaagcucaagcaccagcucaaacgcgagcacagccacaagcauccacucaaaccaaaccgugagcacacgccucggcuccaccgcaggcucaggcaccaacguaagcucacuccccuccaccgccagaaccagaagcuggguagaggaccaaaaccgaaaccuaagcccauucaugcgcggagcccacaacauauccuuuguaacaccaccauccucgcgcuccuccucccaaggaaccgucuccacaguacccaaagaaguccuagacucauggaccggcgcauucaacacccgacgccaaccccuauucgcacacauccgcaggcgcggcgaaucacgcguauaa

SEQ ID NO: 39483 - RNA, 807 nt, Artificial Sequence
  derived and/or modified sequence opt11 from capsid_protein_VP2__Norovirus__AFX81137
auggcaggcgcauucuucgccggccuagccagcgacguccucggcucaggccucggcucacucauaaacgccggcgccggcgccaucaaccaaaaaauagacuucgaaaacaaccgcaaacuccaacaagccagcuuccaauucagcucaaaccuccaacaagccucauuccaacacgacaaagaaaugcuccaagcacaaauagaagcaacaaaaaaacuacaacaggaaaugaugaaagucaaacaagcaaugcuacucgaaggcggcuucucagaaaccgacgcagcaagaggcgccauaaacgccccaaugacaaaaguacuagacuggucaggcacacgcuacugggcacccgacgccagaaccacaaccuacaacgcaggccgauucucaaccccacaacccuccggaacccugccagggcgcauaaacccgcgcacccccacaccagcacgcggaagcucaagcacaagcuccaacgcaagcaccgccacaagcauacacucaaaccaaaccguaagcacacgccuaggcuccaccgcaggcucaggcacgaacguaagcucacucccaagcacagccaggaccaggagcugggucgaggaccaaaaccgaaaccuaagcccauucaugcgcggagcccacaacauaagcuucgucacccccccaagcucgcgaucaagcucacaaggaacaguauccaccgucccaaaagaaguccucgacagcuggacaggcgcauucaacacaagaagacaaccccuauucgcccacauccgccgacgcggagaaucaagagucuga

SEQ ID NO: 39484 - RNA, 807 nt, Artificial Sequence
  derived and/or modified sequence opt11 from capsid_protein_VP2__Norovirus__AFX81140
auggcgggcgcauucuucgccgggcucgcgagcgacguccuaggaucgggcuuaggcucacucauaaacgcaggcgcgggcgcaaucaaccaaaagaucgacuucgagaacaaccgcaagcuccagcaagcgagcuuccaauucagcucgaaccuacaacaagccucguuccagcacgacaaagagauguugcaagcacaaauagaagcaacaaagaaacuacaacaggaaaugaugaaggucaagcaagcaaugcuacuagaaggcggguucucggaaacggacgcggccaggggcgcgaucaacgccccgaugacaaaagugcucgacuggucgggcacgcgcuacugggcgcccgacgccagaaccaccaccuauaacgcaggcagauucucaaccccgcaaccgagcgggaccuugcccgggcgcauaaacccgcgcacacccacgcccgcgcgcggaagcucgagcacaagcuccagcgcaagcacggccacgagcauacacucaaaccagaccgugagcacgcgccugggcucgaccgcgggaucaggcacgaacguauccucgcuaccgagcacggccaggacaagaagcugggucgaggaccagaacaggaaccuaagcccguucaugcgcggagcccacaacauaaguuucgucacgccaccgagcucccgcucaagcucgcaagggaccgucagcacggucccgaaagagguccuggacucauggacaggcgcguucaacaccagacgccaaccccuguucgcgcacauacgaaggcgcggagaaucgcgaguguga

SEQ ID NO: 39485 - RNA, 807 nt, Artificial Sequence
  derived and/or modified sequence opt11 from capsid_protein_VP2__Norovirus__AFX81143
auggcgggcgccuucuucgccggacucgcaagcgacguccuaggcucaggccuaggaucgcucauaaacgcaggcgcgggugcaaucaaccaaaaaaucgacuucgaaaacaaccgcaaacuccaacaagcauccuuccaauucagcucaaaccugcaacaagccucguuccaacacgacaaagaaaugcuacaagcccaaauagaagcaaccaaaaaacuacaacaggaaaugaugaaagucaaacaagcaaugcugcucgaaggcggauucucagaaacagacgcagccagaggcgcaaucaacgcccccaugacaaaaguccuagacuggucaggaacccgcuacugggcacccgaugccaggaccacaaccuacaacgcaggaagauucucaaccccacaaccaagcggaacccuccccggacgcauaaacccacgaauacccacacccgcacgcgggagcucgagcacaagcucgaacgcaagcacggccacauccauauacucaaaccagacaguauccacacgccuaggcucgaccgcagguucaggcacaaacguaagcucacuccccuccacagccagaaccagaagcugggucgaggaccagaaccgaaaccuaagcccauucaugcgcggagcccacaacauaagcuucgucacacccccaagcucacgcucaagcucacaagggaccgugagcacagucccgaaagaaguccuggacuccuggacaggcgcauucaacaccagacgccagccccuauucgcccacauacgcagacgcggagaaucgcgcguguga

SEQ ID NO: 39486 - RNA, 807 nt, Artificial Sequence
  derived and/or modified sequence opt11 from capsid_protein_VP2__Norovirus__AFX81149
auggcuggcgccuucuucgcaggacucgccuccgacguccucggcucaggccucggcucccuaaucaacgccggagccggcgccaucaaccaaaaaaucgacuucgaaaacaaccgaaagcuccaacaagccuccuuccaauucagcuccaaccuucaacaagccucauuccaacacgacaaagaaaugcuucaagcccaaauagaagcgaccaaaaaacuacaacaagaaaugaugaaagucaaacaagccaugcuccuagaaggcggcuucuccgaaacagacgcagcccgcggagcaaucaacgcccccaugacaaaaguccucgacugguccggcacccgcuacugggcacccgacgcccgaaccacaaccuacaacgccggccgcuucucaaccccccaaccaagcggaacacuacccggccgcaucaacccccguacccccacccccgcccgcgguuccucauccacaagcucaaacgcauccacagccacauccauccacuccaaccaaaccgucagcacccgccuaggcuccaccgcaggcucaggcaccaacgucuccucccucccaagcacagcccgcacccgauccuggguagaagaccaaaaccgcaaccugucccccuucaugcgcggcgcccacaacauauccuucgucacacccccauccucccgcuccagcucccaaggaaccguaagcacaguccccaaagaaguccuagacucauggaccggcgcauucaacacccgacgacaaccccucuucgcacacauacgcagacgcggcgaaucccgaguauaa

SEQ ID NO: 39487 - RNA, 807 nt, Artificial Sequence
  derived and/or modified sequence opt11 from capsid_protein_VP2__Norovirus__AFX81152
auggccggcgcauucuucgccggacucgccucagacguccuaggcucgggccucggcucccucaucaacgcaggcgcaggcgccaucaaccagaaaaucgacuucgaaaacaaccgcaaacuccaacaagccuccuuccaauucagcucaaaccuccaacaagccucauuccaacacgacaaagaaaugcuccaagcccaaaucgaagccaccaagaaacuccaacaaggcaugaugaaagucaaacaagcaaugcuacucgaaggcggcuucuccgaaacagacgccgcccgaggcgccaucaacgccccaaugacaaaaguacucgacuggucaggcacccgauacugggcccccgacgcccgcaccacaacauacaacgcaggccgauucuccacaccccaaccaagcggcacccuaccaggccgcaucaacccacgcacccccacccccgcccgcggcagcuccagcaccuccucgaacgccuccacagcaaccagcauccacucaaaccaaaccgucagcacacgccucggcuccacagcaggcuccggcaccaacgucagcucacuccccagcaccgccagaacccgaagcugggucgaagaccaaaaccgaaaccucucaccauucaugcgcggagcccacaacauuuccuucgucaccccacccuccucccgcucauccucacaaggcaccgucucaaccguacccaaagaaguccucgacuccuggaccggcgccuucaauaccagacgacaaccccucuucgcacacauccgccgccgcggcgaaucacgcgucuga

SEQ ID NO: 39488 - RNA, 807 nt, Artificial Sequence
  derived and/or modified sequence opt11 from capsid_protein_VP2__Norovirus__AFX81155
auggcaggagccuucuucgcaggacucgcaagcgacguccuaggcucaggccuaggaucccucauaaacgcaggcgccggcgccaucaaccaaaaaaucgacuucgaaaacaaccgcaaacuccaacaagcaagcuuccaauucagcucaaaccuccaacaagccucauuccagcacgacaaagaaaugcuacaagcacaaaucgaagccaccaaaaaacuacaacaagaaaugaugaaagucaaacaagcaaugcugcucgaaggcggguucuccgaaacggacgccgcccggggcgcaaucaacgccccaaugacaaaaguacucgacuggucaggcacccgcuacugggcgcccgacgccaggaccacaaccuacaacgcgggccgauucucaaccccacaaccaagcggcacccuacccggccgcauaaacccacgaaccccaacaccagcacgcgggagcucaagcacaagcucaaacgcaagcaccgccacauccauacacucaaaccaaaccguauccacacgccucggcucaaccgcgggcucaggcacaaacguacccucacucccaagcacagcccgaaccagaagcugggucgaggaccaaaacagaaaccugagcccauucaugcgcggcgcccaaaacaucagcuucgucacgccccccaguucccgcucaagcucccaaggcaccguauccacaguccccaaagaaguccuagacucauggaccggcgcauucaacacccgacgccaaccccuauucgcacacauacgccgccgcggagaaucacgcgucuaa

SEQ ID NO: 39489 - RNA, 807 nt, Artificial Sequence
  derived and/or modified sequence opt11 from capsid_protein_VP2__Norovirus__AFX81158
auggccggcgccuucuucgccggccucgccuccgacguccucggcuccggccucggcucgcucaucaacgcaggcgcaggcgccaucaaccaaaaaaucgacuucgaaaacaaccgcaaacuccaacaagccuccuuccaauucucauccaaccuccaacaggccuccuuccaacacgacaaagaaaugcuccaagcccaaauagaagcaaccaaaaaacuacaacaagaaaugaugaaagucaaacaagccaugcuccucgaaggcggcuucuccgaaaccgacgccgcccgcggagccaucaacgcccccaugacaaaaguacuugacuggucaggcacaagauacugggcccccgacgcccgcaccaccaccuacaacgccggucgcuucuccaccccccaacccuccggcacccuccccggccgcaucaacccgcgcacccucacccccgcacgcggguccucaagcacaucaucaaacgcauccaccgcaaccucaauacacucaaaccaaacaguauccacccgccucggcuccaccgccggcucuggcacaaacgucuccucccuccccagcaccgcccgcacccgcuccugggucgaagaccaaaaccgcaaccucagcccguucaugcgcggcgcccacaacaucagcuucgucacccccccauccucacgcucaagcucacaaggcaccgucuccaccguccccaaagaaguccucgacucauggaccggcgccuucaacacccgccgccaaccccucuucgcacacauacgccgccgaggcgaaucccgcguauaa

SEQ ID NO: 39490 - RNA, 807 nt, Artificial Sequence
  derived and/or modified sequence opt11 from capsid_protein_VP2__Norovirus__AFX81164
auggcaggcgccuucuucgcaggacuagccagcgacguccucggcucgggccuaggcucacucauaaacgcaggcgccggcgcaauaaaccaaaaaaucgacuucgaaaacaaccgaaaacuccaacaagcaagcuuucaauucuccuccaaccuacaacaagcauccuuccaacacgacaaagaaaugcuacaagcgcaaaucgaagcaaccaaaaaacuccaacaagaaaugaugaaagucaagcaagccaugcuacucgaaggcggauucucagaaaccgacgcagcccgcggcgccaucaacgccccaaugaccaaaguacucgacugguccggcacacgauacugggcgccagacgcccgcaccacaaccuacaacgcaggcagauucucaaccccccaaccguccggcacacuacccggccgcaucaacccccgcacacccacaccagcacgcggaagcuccagcaccagcucgaacgcguccacagcaaccagcaucuacucaaaccaaacagucuccacacgccucggcucaaccgcagguucaggcacaaacgucagcucccuccccuccaccgccagaaccagaagcugggucgaagaccaaaaccgaaaccugagcccauucaugcgcggagcccacaacaucagcuucgucacccccccauccucacgcuccuccucccaaggcaccguaagcaccguaccaaaagaaguccuagacuccuggaccggcgcguucaacacccgccgccaaccccuuuucgcccacauacgccgacgcggagaaucacgcguauaa

SEQ ID NO: 39491 - RNA, 807 nt, Artificial Sequence
  derived and/or modified sequence opt11 from capsid_protein_VP2__Norovirus__AFX81173
auggcgggcgcguucuucgccgggcuagcgagcgacguacuaggcucuggccugggaucacucauaaacgcgggagcgggcgcgauaaaccaaaagaucgauuucgagaacaaucgcaaacuccagcaagcgagcuuccaauucaguucgaacuugcaacaagccucguuccagcacgacaaagagaugcugcaagcacaaauagaagcaacaaagaaacugcaacaggaaaugaugaaggucaaacaagcgaugcugcucgaaggcggguucucggaaacagacgcggccagaggcgcgaucaacgccccaaugacgaaagugcucgacuggucaggcacacgcuacugggcgcccgacgccaggaccacgaccuacaacgccggcagauucucgaccccgcaaccaagcggcacacugcccgggcgcauaaacccgcgcacgcccacacccgcacgcgggagcuccagcacaagcucgaacgcguccacggccacgagcauacacucaaaccagaccgugagcacgcgccugggcucaaccgcgggcuccggcacgaacguaagcucgcucccgagcacggccaggaccaggagcugggucgaggaccagaacagaaaccugagcccauucaugcgcggggcccacaacaucagcuuuguaacaccaccaagcucgcgcucaagcucgcaaggaacagugagcacgguaccgaaagagguccuagacucauggacaggcgcguucaacaccaggcgccagccccuguucgcacacauacgcagacgcggagaaucgcgcguauga

SEQ ID NO: 39492 - RNA, 807 nt, Artificial Sequence
  derived and/or modified sequence opt11 from capsid_protein_VP2__Norovirus__AFX81179
auggccggcgcauucuucgccggacucgccagcgacguccuaggcucaggccugggcucccucauaaacgcaggcgcaggcgcgaucaaccaaaaaaucgacuucgaaaacaaccgcaaacuucaacaagcaaguuuccaauucagcucaaaccuccaacaggccucauuccaacacgacaaagaaaugcuacaagcacaaauagaagccaccaaaaaacuacaacaagaaaugaugaaagucaaacaagcgaugcuacuugaaggcggcuucucagaaacagacgcagcaagaggcgcaaucaacgccccaaugacaaaaguccucgacugguccggcacacgcuacugggcacccgacgcaaggaccaccaccuacaacgcgggccgauucucaaccccacaaccaagcggaacccuacccggccgcaucaacccccgaacacccacaccagcacgcggcuccucaagcacaagcucaaacgccucaacagccacgagcauacacuccaaccagaccgucuccacccgacucggcucaaccgccggcucaggcacaaacgucagcucacucccauccacagcaagaacccgaagcugggucgaagaccaaaaccgaaaccuaagcccauucaugcgcggcgcccacaacaucuccuucgucacaccccccagcucccgcucaagcucccaaggcacagucagcacaguccccaaagaaguccuagacuccuggacaggcgcauucaacacacgccgacagccccucuucgcacacauacgcagacgcggagaaucccgcgucuaa

SEQ ID NO: 39493 - RNA, 807 nt, Artificial Sequence
  derived and/or modified sequence opt11 from capsid_protein_VP2__Norovirus__AFX81182
auggcaggcgcauucuucgccggacucgcaagcgacguccugggcucaggccuaggcucccucauaaacgccggagccggcgcaaucaaccaaaaaaucgacuucgaaaacaaccgcaagcuccaacaagcaagcuuccaauucagcucaaaccuccaacaagccuccuuccaacacgacaaagagaugcuacaagcacaaauagaagcaaccaaaaaacuccaacaagaaaugaugaaagucaaacaagcaaugcuccucgaaggcggauucucggaaacagacgcagccagaggagccaucaacgccccaaugaccaaaguacucgacuggucaggcacaagauacugggcaccagacgccaggaccacaaccuacaacgcaggccgcuucucaaccccacaaccaagcggaacccuacccggacgaauaaacccgcgaacacccacacccgcacgcggaagcuccuccaccagcuccaacgccagcaccgccacgagcauauacucaaaccaaaccgugagcacacgccuaggcucaaccgcaggcucgggcacaaacgucagcucacucccauccacagccagaaccagaagcugggucgaagaccaaaacagaaaccuaagcccauucaugcgcggcgcccacaacaucuccuucgucacgccaccaagcucacgcucaagcucacaaggaacaguaagcacagucccaaaagaaguccuagacuccuggacaggcgccuucaacacccgccgacaaccucuauucgcacacauacgcagacgcggagaaucgcgcguauaa

SEQ ID NO: 39494 - RNA, 807 nt, Artificial Sequence
  derived and/or modified sequence opt11 from capsid_protein_VP2__Norovirus__AFX81185
auggcaggcgcauucuucgccgggcucgcgagcgacguccugggcucgggcuuaggcucgcucauaaacgcaggcgcgggagcaauaaaccaaaaggucgacuucgagaacaaccgcaagcuccagcaagccagcuuccaauucagcucaaaccugcaacaggcaucguuccagcacgacaaagagaugcugcaagcgcaaaucgaagcgaccaagaaauuacaacaagaaaugaugaaggucaagcaagcaaugcugcucgagggcggguucucggaaacagacgcggcaaggggcgcgaucaacgccccaaugacgaaaguacucgacuggucgggcacgcgcuacugggcccccgacgccaggacaacaaccuauaacgcaggcagguucucaacaccacaaccaagcggaacccuacccgggcgcauaaacccgcgcacgcccacgcccgcacgcgggagcucaaguacgagcucgaacgcaagcacagccacgagcauacacucgaaccagaccgugagcacgcgacuaggcuccaccgcgggaucaggcacgaacgugagcucccucccgagcacagccaggacacgcagcugggucgaggaccagaacaggaaccugagcccauucaugcgcggagcacacaacaucagcuucgucacacccccaagcucacgaucaagcucacaaggaaccgugagcacggucccgaaagagguacuggacuccuggacgggcgcauucaacaccagacgccagccccuauucgcgcacauacgcaggcgcggagaaucacgcguauga

SEQ ID NO: 39495 - RNA, 807 nt, Artificial Sequence
  derived and/or modified sequence opt11 from capsid_protein_VP2__Norovirus__AFX81188
auggcgggcgcguucuucgccggccuagcgagcgacguccugggcucaggcuugggcucacucauaaacgcgggcgccggcgcaaucaaccagaaaaucgauuucgaaaacaaccgcaagcuccaacaagcgagcuuccaauucagcucaaaccugcaacaagccucguuccagcacgacaaagaaaugcugcaagcccaaauagaagcgaccaagaaacugcaacaggaaaugaugaaaguaaaacaagcgaugcuacucgagggcggauucucggaaacggacgcggccaggggagcgaucaacgccccaaugacaaaaguacuagacuggucuggcacgcgcuacugggcacccgacgccagaaccacaaccuacaacgcuggcagguucucgaccccacaacccagcggaacacuacccggacgcauaaacccgcgcacgcccacgcccgcgcgcgggagcucaagcaccagcucaaacgcaagcacagcaacaagcauacacucgaaccaaaccgucagcacgcgacugggaucgaccgcgggcucgggcacaaacgugagcucacucccaagcacagccagaaccagaagcugggucgaagaccaaaacaggaaccugucaccguucaugcgcggagcacacaacauauccuucgucacgccaccgagcucgcgaucaagcucacaaggaaccgugagcacagucccgaaagagguccuagacuccuggacgggcgcguucaauaccagacgccaaccacuguucgcgcacauaagaagacgcggggaaucacgagucuga

SEQ ID NO: 39496 - RNA, 807 nt, Artificial Sequence
  derived and/or modified sequence opt11 from capsid_protein_VP2__Norovirus__AFX81191
auggcaggcgcguucuucgccggacucgcaagcgacguccugggcucaggccugggcucccucauaaacgcgggcgcgggagcgaucaaccaaaagaucgacuucgagaacaaccgcaagcuccaacaagccagcuuucaauucagcucgaaccugcaacaagcaucguuccagcacgacaaagaaaugcugcaagcgcaaauugaagcaaccaagaaacugcaacaggaaaugaugaaggucaagcaagcaaugcugcucgagggcggguucucggaaacggacgcggcaaggggcgcgaucaacgccccaaugacgaaagugcucgacuggucgggcacgcgcuacugggcgcccgacgccaggaccacgaccuacaacgcaggaagauucucgaccccacaaccaagcgggacccuacccgggcgaauaaacccacgcacacccacacccgcgcgcgggagcuccagcacgaguuccaacgcgaguacggcaacaagcauacacucaaaccagaccguaagcacgcgccugggcucgaccgcggguuccggcacaaacguaagcucgcucccgaguacggccagaacaagaagcugggucgaagaccaaaacagaaaccugagcccguucaugcgcggagcccacaacaucagcuucgucacgcccccgagcucgcgcucaagcucgcaaggaaccguaagcacaguaccaaaagagguacuggacucguggacgggcgcauuuaacaccaggcgacaaccacuguucgcgcacauacgcaggcgcggggaaucgcgcguguaa

SEQ ID NO: 39497 - RNA, 807 nt, Artificial Sequence
  derived and/or modified sequence opt11 from capsid_protein_VP2__Norovirus__AFX81194
auggccggcgccuucuucgccggacuagccagcgacguccucggcucgggccucggcucccucauaaacgccggagccggcgccaucaaccaaaaaaucgacuucgaaaacaaccgcaaacuccaacaagccuccuuccaauucucaucaaaccuccaacaagccuccuuccaacacgacaaagagaugcuccaagcccaaaucgaagccacaaaaaaacuccaacaagaaaugaugaaagucaaacaagccaugcuccucgaaggcggcuucuccgaaacagacgccgcccgaggugccaucaacgcccccaugaccaaaguccucgacuggucaggcacacgcuacugggcccccgacgcccgcaccacaaccuacaacgccggccgcuucucaacaccccaacccuccggcacccuaccaggccgcguaaacccccgcacacccacacccgcccgcggauccuccuccaccagcuccaacgcaucaaucgccaccuccauauacucaaaccaaaccgucuccacccgccucggcuccacagccggauccgguaccaacguauccucccuccccuccacagcccgcacccgcuccugggucgaagaccaaaaccgcaaccucuccccauucaugcgcggagcccauaacaucagcuucgucacaccccccuccucacgcuccagcucccaaggcaccgucuccacagucccaaaagaaguccuagacucguggacaggcgccuucaacacccgacgccaaccccuauucgcccacauacgccgccgaggcgaaucgcgcgucuaa

SEQ ID NO: 39498 - RNA, 807 nt, Artificial Sequence
  derived and/or modified sequence opt11 from capsid_protein_VP2__Norovirus__AFX81197
auggcaggcgccuucuucgccggacucgcaagcgacguccuaggcucgggccuaggaucgcucauaaacgcaggcgcaggcgcaaucaaccagaaaaucgacuucgaaaacaaccguaaacuccaacaagcuagcuuucaauucagcucaaaccuccaacaagccucguuccagcacgacaaagaaaugcuacaagcgcaaauagaagcgaccaagaaacuacaacaggaaaugaugaaagucaagcaagcaaugcugcucgaaggcggguucucggaaacggacgcggccaggggcgcgaucaacgccccgaugacaaaagugcucgacuggucgggcacacgcuacugggcacccgacgccagaaccaccaccuacaacgcaggcagauucucuaccccgcaaccgagcggaacccuacccggacgcauaaacccgcgaacacccacacccgcacgcggaagcucauccacgagcucaaacgcaagcacagccacaagcauacacucaaaccagaccguaagcacacgccuaggcucgaccgccggcucaggcacgaacgugagcucacucccaagcacagccaggaccagauccugggucgaagaccaaaacagaaaccugagcccguucaugcgcggagcccacaacaucagcuucguaacgcccccgagcucacgcucgagcucacaaggcaccguguccacagucccgaaagaaguccuggacucguggacgggcgcauucaacaccagacgccaaccacuauucgcgcacauacgcagacgcggggaaucacgcguauaa

SEQ ID NO: 39499 - RNA, 807 nt, Artificial Sequence
  derived and/or modified sequence opt11 from capsid_protein_VP2__Norovirus__AFX81200
auggcaggcgccuucuucgccggccucgccuccgacguccuaggcucaggccucggcucccucauaaacgcaggcgccggcgccaucaaucaaaaaaucgacuucgaaaacaaccgcaaacuccaacaagccagcuuccaauucucauccaaccuccaacaagccuccuuccaacacgacaaagaaaugcuccaagcccaaaucgaagccaccaaaaaacuacaacaagaaaugaugaaagucaagcaagccaugcuccucgagggcggcuucucagaaacagacgccgcccgcggugccaucaacgcccccaugaccaaaguccucgacuggucaggcacccgcuacugggccccagacgcccgaaccacaacuuacaacgccggccgcuucuccaccccccaaccaucaggcacccuaccaggacgcaucaacccacgaacccccacccccgcacgcggcagcucaagcaccuccuccaacguaucaacugccaccucaaucuaccucaaccaaaccgucuccacccgacuaggcuccaccgccggauccggcaccaacgucucaucccuccccuccaccgcccgcacccgcuccugggucgaagaccaaaaccgcaaccuauccccauucaugcgcggagcccacaacaucuccuucgucaccccccccucaucacgcuccucaucccaaggcacagucuccaccguccccaaagaaguccuagacuccuggaccggcgccuucaacacccgccgccaaccccucuucgcccacauccgccgccgcggugaaucacgcguauaa

SEQ ID NO: 39500 - RNA, 807 nt, Artificial Sequence
  derived and/or modified sequence opt11 from capsid_protein_VP2__Norovirus__AFX81203
auggccggagccuucuucgcaggacucgccuccgacguccucggcucaggccucggcucccuaauaaacgcaggcgcaggcgcaauaaaccaaaaaaucgacuucgaaaacaaccgcaaacuccaacaagccagcuuccaauucuccuccaaccuacaacaagccucuuuccaacacgacaaagaaaugcuccaagcccaaauagaagccaccaaaaaacuccaacaagaaaugaugaaagucaaacaagccaugcuccuagaaggcggcuucucagaaaccgacgccgcccgaggcgccauaaacgcccccaugaccaaaguacucgacuggucaggcacccgcuacugggccccagacgcccgcaccaccaccuacaacgccggccgauucucaaccccccaaccauccggaacccuccccggccgaauaaacccaagaacacccacccccgcccgaggcuccucuuccacauccuccaacgccagcaccgccaccagcauauacucaaaccaaaccguuuccacacgccucggcucaaccgccggcuccggcaccaacgucagcucccucccaagcaccgcccgcacccgcucaugggucgaagaccaaaaccgcaaccucuccccauucaugcgcggcgcacacaacaucuccuucgucacccccccaagcucccgcuccuccucccaaggaaccgucuccaccguacccaaagaaguccucgacucguggaccggcgccuucaacacccgccgccaaccccucuucgcacacauccgacgccgaggagaaucccgcgucuaa

SEQ ID NO: 39501 - RNA, 807 nt, Artificial Sequence
  derived and/or modified sequence opt11 from capsid_protein_VP2__Norovirus__AFX81206
auggcaggcgcauucuucgccggacucgccuccgacguccucggcuccggccucagcucccucaucaacgccggcgccggcgccauaaaccaaaaaaucgacuucgaaaacaaccgcaaacuccaacaagccuccuuccaauucagcuccaaccuacaacaagcaucauuccaacacgacaaagaaaugcuacaagcccaaaucgaagccaccaaaaaacuucaacaagaaaugaugaaagucaaacaagccaugcuacucgaaggcggcuucuccgaaacagacgcagcccgcggcgcagucaacgcccccaugaccaaaguccucgacuggucaggcacccgcuacugggcccccgacgccagaaccaccaccuacaacgccggacgauucuccacaccucaaccauccggaacccuacccggacgaauaaauccacgcacacccacccccgcccgcggauccucaagcaccagcucaaacgccagcaccgccacauccaucuacucaaaccaaaccgucucaacucgccuaggauccaccgcaggcuccggcaccaacgucuccucccuccccuccacagcccgcacccgcuccugggucgaagaccaaaaccgcaaccuaucccccuucaugcgcggcgcccacaacaucuccuucgucaccccccccucaucccgcuccuccucccaaggcaccgucagcacaguccccaaagaaguccucgacucguggaccggcgccuucaacacccgacgccaaccucucuucgcccacauacgccgacgcggagaaucccgcguauaa

SEQ ID NO: 39502 - RNA, 807 nt, Artificial Sequence
  derived and/or modified sequence opt11 from capsid_protein_VP2__Norovirus__AFX81209
auggccggcgcguucuucgccgggcucgcaagcgauguccuaggcucgggccugggcucacuaauaaacgcgggagcaggcgcaauaaaccaaaagaucgacuucgagaacaaccgcaagcuccagcaagcgagcuuccaauucagcucgaacuugcaacaggccucguuccagcaugacaaagaaauguugcaagcgcaaauagaagcgaccaagaaacuacaacaggaaaugaugaaggucaagcaagcgaugcugcucgagggaggguucucggaaacagacgcagccagaggcgcgaucaacgccccgaugacgaaagugcuugacuggucaggcacgcgcuacugggcgcccgacgcccgaaccacaaccuacaacgcgggcagauucucgaccccacaaccgagcgggaccuugcccgggcguauaaacccgcgcacgccaacgcccgcgcgaggauccucaagcacgagcucgaacgcaagcacagccacaagcauauacucgaaccagaccguaagcacgcgcuugggcucgaccgcgggaucgggcacgaacgugagcucucucccaagcacggccaggaccaggagcugggucgaggaccagaaccggaaccugagcccguucaugcgcggggcccacaacaucagcuuuguaacacccccaagcucacgcucgagcucgcaaggaaccgugagcacggucccgaaagagguccuggacucguggacgggcgcguucaacaccagaagacaaccacuguucgcacacauacgcaggcgcggggaaucgcgcgucuga

SEQ ID NO: 39503 - RNA, 807 nt, Artificial Sequence
  derived and/or modified sequence opt11 from capsid_protein_VP2__Norovirus__AFX81212
auggccggcgccuucuucgccggccucgccuccgacguccucggcuccggccucggcucacuuaucaacgccggcgccggagccaucaaccaaaaaaucgacuucgaaaacaaccgcaaacuccaacaagccucauuccaauucuccuccaaccuacaacaagccucauuccaacacgacaaagaaaugcuacaagcacaaaucgaagccaccaaaaaacuccaacaagaaaugaugaaagucaaacaagccaugcuccucgaaggcggcuucuccgaaaccgacgcugcccgaggcgccaucaacgcccccaugacuaaaguacucgacugguccggcacacgcuacugggcacccgacgcacgaaccaccaccuacaacgccggccgcuucucaaccccccaaccaagcggaacacuccccggccgcaucaacccacgcacccccacccccgcccgcggauccuccucaaccaccucaaacgccuccaccgccaccuccauccacuccaaccagacagucuccacccgccucggcuccaccgccggcuccggaaccaacguauccucacuccccaguaccgcccgaacccgauccugggucgaagaccaaaaccgaaaccuauccccauucaugcgcggcgcccacaacauauccuucgucaccccccccuccucccgcuccucaucccaaggcaccguuuccaccguacccaaagaaguccuagauuccuggaccggcgcuuucaacacacgccgccaaccacucuucgcacacauccgccgccgcggagaauccagagucuaa

SEQ ID NO: 39504 - RNA, 807 nt, Artificial Sequence
  derived and/or modified sequence opt11 from capsid_protein_VP2__Norovirus__AFX81215
auggccggcgccuucuucgccggccucgccucugacguccucggcuccggccucggcucacucauaaacgccggcgccggagccaucaaucaaaaaaucgacuucgaaaacaaccgcaaacuacagcaagccuccuuccaauucuccuccaaccuccaacaggccucauuccagcacgauaaagaaaugcuacaagcccaaaucgaagccaccaaaaaacuccaacaggaaaugaugaaagucaaacaagcaaugcuccucgaaggcggauucuccgaaaccgacgccgcccgcggcgccgucaacgcccccaugaccaaaguacucgacugguccggcacccgcuacugggcgccagacgcccgcaccaccaccuacaacgcaggcagauucuccaccccccaaccauccggcacccuccccggccgcaucaacccccgcacccccacccccgcccgaggcuccucauccacauccucaaacgcccccauagccacauccauauacucaaaccaaacaguauccacccgccucggauccaccgcaggcuccggcacaaaugucuccucccuucccuccaccgcccgcacccgauccuggguugaagaccaaaaccgcaaccucuccccauucaugcgcggcgcccacaacaucucauucgucacaccacccucaucccgcuccagcucccaaggcaccgucucaaccguccccaaagaaguccucgacuccuggacaggcgccuucaacacccgccgacaaccccuauucgcacacauccgaagacgcggagaaucacgcgucuaa

SEQ ID NO: 39505 - RNA, 807 nt, Artificial Sequence
  derived and/or modified sequence opt11 from capsid_protein_VP2__Norovirus__AFX81218
auggcgggcgcauucuucgccgggcucgcauccgacguucugggcucgggacugggcucgcucauaaacgcaggcgcaggcgcgaucaaccaaaagaucgacuucgagaacaaccgcaagcuacagcaagcgagcuuccaauucagcucaaaccugcaacaagccucauuccagcacgacaaagaaaugcuccaagcacaaaucgaagcgaccaagaaacugcaacaagaaaugaugaaagucaagcaagcgauguugcuagaaggcggguucucggaaacagacgcggcccggggcgcgaucaaugccccgaugacgaaaguacucgacuggucgggcacgcgcuacugggcgccagacgcccgaaccacgaccuacaacgcgggaagauucucaacaccgcaaccaagugggacccugcccgggcgaauaaacccgcgcacgcccacgcccgcgcgagggagcucaagcacgagcucgaacgcaagcacagccacgagcauauacucgaaccagacaguguccacgcgccuaggcucgaccgcaggcuccggcaccaacgucagcucacucccaaguacggccaggaccagaagcugggucgaggaccagaacaggaaccuaagcccauucaugcgcggagcccacaacaucagcuucgucacgcccccaagcucacgcucgagcucacaagggaccguaagcacaguaccgaaagagguccuggacucguggacaggcgcguucaauaccaggcgccagccccuguucgcucacauacgcaggcgaggagaaucgcgcguauga

SEQ ID NO: 39506 - RNA, 807 nt, Artificial Sequence
  derived and/or modified sequence opt11 from capsid_protein_VP2__Norovirus__AFX81221
auggcaggcgccuucuucgccggacucgcaagcgacguccugggcucgggccuaggcucgcucauaaacgcaggcgcaggcgcaauaaaccagaaaaucgacuucgaaaacaaccgcaagcuccaacaagcauccuuccaauucagcuccaaccuacaacaagccucauuccaacacgacaaagaaaugcugcaagcacaaauagaagccaccaagaaacugcaacaagaaaugaugaaagucaaacaagcgaugcugcuagagggcggguucucagaaacggacgcggcaagaggcgcaauaaacgccccgaugaccaaaguacucgacuggucgggcacacgcuacugggcgcccgacgccagaaccacaaccuacaacgcgggccgauucucaaccccacaaccgagcgggacccuacccggacgcauaaacccacgaacgcccacacccgccagaggcagcccgagcacaagcuccaacgcgagcacagccacauccaucuacuccaaccaaacagugagcacacgccuaggcuccaccgcaggcucaggcacgaacguguccucacucccgagcaccgccaggaccagguccugggucgaagaccaaaacagaaaccugagcccguucaugcgcggggcacacaacaucagcuucgucacacccccauccucacgcucaagcucacaaggaacaguaagcacagucccaaaagaaguccuagacucauggacaggcgcauucaacaccagacgccaaccccuguucgcacacauacgccggcgcggagaaucacgcguauga

SEQ ID NO: 39507 - RNA, 807 nt, Artificial Sequence
  derived and/or modified sequence opt11 from capsid_protein_VP2__Norovirus__AFX81224
auggccggcgcauucuucgccggacucgccagcgacguccuaggcuccggccucggcucgcucauaaacgcaggcgcaggcgcaaucaaccaaaaaaucgacuucgaaaacaaccgcaaacuccaacaagcgagcuuccaauucagcucaaaccuacaacaagccuccuuccaacacgacaaagaaaugcuccaagcacaaauagaagcgaccaaaaaacuacaacaagaaaugaugaaagucaagcaagcaaugcuccucgaaggcgguuucuccgaaacagacgcagcaagaggcgcaaucaacgccccaaugacaaaaguccucgacuggucaggaacccgcuacugggcacccgacgcccgcaccacaaccuauaacgccggccgguucucgaccccccaacccuccgggacccuacccggacgaaucaaccccagaacaccaacacccgcacgcggauccucauccacaagcuccaacgcauccacagccacaagcauauacucaaaccaaaccgucagcacacgacugggcuccaccgcaggcuccggaacaaacgucagcucccucccaagcacagcccgaaccagaagcugggucgaagaccaaaacagaaaccuaagcccauucaugcgcggagcccacaacauaagcuucgucaccccccccuccucacgcucgagcucccaaggcacagucagcacagucccaaaagaaguccuagacucauggaccggcgccuucaacacccgccgccaaccacucuucgcacacauccgccgccguggcgaaucacgcgucuaa

SEQ ID NO: 39508 - RNA, 807 nt, Artificial Sequence
  derived and/or modified sequence opt11 from capsid_protein_VP2__Norovirus__AFX81227
auggccggcgcauucuucgccggccucgccuccgacguccucggaucuggccuaggcucacucaucaacgccggagccggcgccaucaaccaaaaaaucgacuucgaaaacaaccgcaaacuucaacaagccucauuccaauucuccuccaaccuccaacaggccuccuuccaacacgacaaagaaaugcuacaagcccaaaucgaagccaccaaaaaacuccaacaagaaaugaugaaagucaaacaagccaugcuucuagaaggcggcuucuccgaaaccgacgccgcacguggcgccaucaacgcacccaugaccaaaguccucgacuggucaggcacccgauacugggcccccgacgcccgcaccacaacauacaacgccggacgcuucuccaccccccaacccuccggcacccuccccggccgcauaaacccacgcacccccaccccagcccgcggcucauccuccaccagcuccaacgccagcaccgccaccuccauauacuccaaccaaaccguauccacccgccucggcucaaccgccggcuccggaacaaacguauccucacuccccucaaccgcacgcacccgcuccugggucgaagaccaaaaccgcaaccucucccccuucaugcgcggcgcccacaacaucucauucgucaccccccccuccucccgaucaucaucacaaggcaccgucagcaccguccccaaagaaguccucgacuccuggaccggcgccuucaacacccgccgacaaccccucuucgcccacauccgccgacgcggcgaaucccgcgucuaa

SEQ ID NO: 39509 - RNA, 807 nt, Artificial Sequence
  derived and/or modified sequence opt11 from capsid_protein_VP2__Norovirus__AFX81230
auggcgggagcauucuucgccggccucgcaagcgacguccuaggaucaggccuaggcucacucauaaacgcaggcgcaggcgcaaucaaccaaaaaaucgacuucgaaaacaaccgcaaacuccaacaagcaagcuuccaauucagcucagaccuacaacaagccucauuccaacacgacaaagaaaugcuacaagcacaaauagaagccaccaaaaaacuccaacaagaaaugaugaaggucaaacaagcgaugcuacucgaaggcggauucucggaaacggacgcagcacgaggcgcaaucaacgccccaaugacaaaagugcucgacuggucgggcacccgcuacugggcaccagacgccagaaccacgaccuacaacgcaggccgguucucaaccccgcaaccguccgggacccugcccgggcgaauaaacccacgcacacccgcgccagcucgcgggagcucgagcacaagcucaaacgcgagcacagccacaagcauauacuccaaccaaaccguaagcacacgccuaggcucaaccgcgggcucgggcacaaacguauccucgcucccgagcacagccagaaccagaagcuggguagaggaccaaaaccgaaaccuaagcccauucaugcgcggagcccacaacauaagcuucgucacgcccccaagcucccgcucaagcucacaagggaccgugagcacaguaccaaaagaaguccuggacucauggacaggcgcauucaacaccagacgccaaccccucuucgcacacauacgaaggcgcggggaaucacgaguauaa

SEQ ID NO: 39510 - RNA, 807 nt, Artificial Sequence
  derived and/or modified sequence opt11 from capsid_protein_VP2__Norovirus__AFX81233
auggccggagcuuucuucgccggccuagcaucagacguacuaggcucaggccucggcucccucaucaacgccggcgccggcgccaucaaccaaaaaaucgacuucgaaaacaaccgcaaacuccaacaagccuccuuccaauucuccuccaaccuccaacaagcaucauuccaacacgacaaagaaaugcuccaagcccaaaucgaagccaccaaaaaacuccaacaagaaaugaugcgcgucaaacaagcaaugcuccucgaaggcggauucuccgaaaccgacgccgcccgaggagccaucaacgccccaaugacaaaaguccucgacugguccggcacccgcuacugggcacccgacgcccgcaccaccaccuacaaugcaggccgcuucucaaccccccaaccuuccggcacccuacccggccgaaucaacccccgcacccccacccccgcccgaggcucaucauccacauccuccaacgucucaaccgccaccucaaucuacuccaaccaaaccuucucaacacgccucggcuccaccgccggcuccggcaccaacgucuccucccuccccucaaccgcccgaacacgauccugggucgaagaccaaaaccgaaaccucucccccuucaugcgcggcgcccacaacaucuccuuugucacccccccuuccucccgcuccuccucccaaggcaccguauccaccgucccaaaagaaguccucgacucauggacaggcgccuucaacacccgccgccaaccccucuucgcccacauccgccgucgcggcgaaucccgagucuaa

SEQ ID NO: 39511 - RNA, 807 nt, Artificial Sequence
  derived and/or modified sequence opt11 from capsid_protein_VP2__Norovirus__AFX81239
auggcaggcgccuucuucgccggccucgccucagacguacucggcucaggccuaggcucccucaucaacgccggagccggcgccaucaaccaaaaaaucgacuucgaaaacaaccgcaaacuacaacaagccuccuuccaauucuccuccaaccuacaacaagccuccuuccaacacgacaaagaaaugcuacaagcccaaaucgaagcaaccaaaaaacuccaacaagaaaugaugaaagucaaacaagccaugcuccucgaaggcggcuucucagaaacagacgccgcccgcggagccaucaacgcccccaugacaaaaguccuagacuggucgggcacccgcuacugggcccccgacgcccgcacaacaaccuacaacgcaggcagauucucuaccccccaacccuccggcacccuccccggccgaauuaacccucgcacucccacccccgcccgcggcuccuccuccaccuccuccaacguauccaccgccacauccaucuacuccaaccaaaccgcauccacccgccucggcuccaccgccggcuccggcaccaacgucuccucacucccauccacagcccgaacccgauccugggucgaagaccaaaaccgcaaccuaucacccuucaugcgcggagcccacaacaucagcuucgucaccccccccuccucccgcuccuccucccaaggcaccguauccaccgucccuaaagaaguccucgacuccuggaccggcgcauucaacaccagacgccaaccacuauucgcccacauacgccgccgcggcgaaucccgcgucuaa

SEQ ID NO: 39512 - RNA, 807 nt, Artificial Sequence
  derived and/or modified sequence opt11 from capsid_protein_VP2__Norovirus__AFX81242
auggcaggcgcauucuucgccggccucgcaagcgacguccugggaucaggccuaggcucacucaucaacgccggcgccggcgcaaucaaccaaaaagucgaauucgaaaacaaccgcaaacuccaacaagcaagcuuccaauucuccuccaaccuacaacaagccucauuccagcacgacaaagaaaugcuacaagcacaaauagaagcaaccaaaaaacuccaacaagaaaugaugagagucaaacaagccaugcuacucgaaggaggauucucagaaacagaugccgccagaggcgcaaucaacgcacccaugaccaaaacacucgacuggaccggcacccgcuacugggcacccgacgccagaaccacaaccuacaacgcaggccgauucuccacaccgcaacccagcggcgcccuacccggacgcgcaaaccuccgcgccaccguacccgcacgcggaagcucguccacauucucaaacuccuccauagccacauccgucuacucaaaccaaaccaccagcacccgccucggcucaaccgccggcucuggcacauccguaagcucccucccaagcaccgccaggaccagaagcugggucgaagaccaaaacagaaacuugagcccauucaugcgaggagcccacaacauaagcuucgucacaccccccagcucacgaucaagcucacaaggcaccguaagcacagucccgaaagaaguccuagacucauggacaggcgcauucaacaccagacgacaaccccucuucgcacacauccgcaaacgaggcgaaucccgagucuaa

SEQ ID NO: 39513 - RNA, 807 nt, Artificial Sequence
  derived and/or modified sequence opt11 from capsid_protein_VP2__Norovirus__AFX81245
auggcaggcgcguucuucgccgggcucgcuagcgacguauuaggcuccggccuaggcucacucauaaacgcaggcgcgggcgcgauaaaccaaaaaguagaguucgagaacaaccgcaagcuacagcaagcgagcuuccaauucagcucgagcuuacaacaggccucguuccaacacgacaaagagaugcugcaagcgcaaaucgaagcgaccaagaaacuacaacaggaaaugaugagagucaagcaagccaugcuacucgagggaggguucucggaaacagacgccgccaggggcgcgaucaacgccccgaugacgaaaacgcucgacugguccggcacacgcuacugggcaccagacgcccgaaccacgaccuacaacgcgggaagauucucaaccccgcaaccgagcggagcccuacccggacgcgcaaaccugcgugcgaccguacccgcgcgcgggagcucaagcacaagcucgaacucgagcauagccacgagcgucuacucaaaccagaccacgagcacgcgccuaggcucuacagcgggcucgggcacaagcgugagcucgcuccccagcacggcacgaaccagaagcugggucgaggaccagaacaggaaccugagcccguucaugcgcggggcccacaacaucagcuucgucacgccaccaagcucgcgaucgagcucgcaagggaccgugagcacggucccgaaagagguacuagacucguggacaggcgcguucaauaccagacgccaaccccuguucgcacacauacgcaagcgcggggaaucgcgcguguga

SEQ ID NO: 39514 - RNA, 807 nt, Artificial Sequence
  derived and/or modified sequence opt11 from capsid_protein_VP2__Norovirus__AFX81248
auggccggcgcguucuucgccggccucgccagcgacgucuuaggcuccggccucggcucacucaucaacgccggcgccggagccaucaaccaaaaaguugaauucgaaaacaaccgcaaacuccaacaagccuccuuccaauucuccuccaaccuccaacaagccucauuccagcacgacaaagaaaugcugcaagcccaaaucgaagcaacccgcaaacuacaacaagaaaugaugcggguaaaacaagcaaugcuccucgaaggcggauucucagaaaccgacgccgcccggggcgcaaucaacgccccaaugacaaaaacccucgacugguccggcacccgcuacugggccccagacgcccgcaccaccaccuacaacgccggcagauucuccaccccccaacccuccggcgcccuacccggccgcgccaaccuucgcgccaccguacccgcccgcggcuccucauccaccuucuccaacucauccaucgccacaagcgucuacucaaaccaaaccaccagcacucgccuaggcuccaccgccggcuccggcacauccgucuccucacucccuuccaccgcccgcacccgaagcuggguagaagaccaaaaccgaaaccucagcccauucaugcgcggcgcccacaacauauccuucgucacccccccuagcucccgcucauccucacaaggaaccgucuccacaguccccaaagaaguccuagacuccuggaccggcgccuucaacacccgucgccagccacuauucgcacacauccgaaaacgcggagaaucacgcguauaa

SEQ ID NO: 39515 - RNA, 807 nt, Artificial Sequence
  derived and/or modified sequence opt11 from capsid_protein_VP2__Norovirus__AFX81251
auggccggcgccuucuucgccggacucgccuccgacguccuaggaucaggccucggaucccuaauaaacgcgggcgccggcgccauaaaccaaaaagucgaauucgaaaacaaccgcaagcuacaacaagcauccuuccaauucaguucuaaccuccaacaagccuccuuccaacacgacaaagaaaugcuccaagcccaaauagaagccaccaaaaaacuacaacaagaaaugaugcgagucaaacaagccaugcuccuagaaggcggcuucucagaaacagacgcagcccguggcgcaaucaacgcccccaugaccaaaacccucgacugguccggaacccgcuacugggcccccgacgcccgaacaaccaccuacaacgcaggccgcuucucgaccccccaaccauccggagcccuccccggacgcgccaaccuccgcgccacaguccccgcccgcggaagcuccuccaccuucuccaacucuuccaucgccaccuccguauacuccaaccaaaccaccuccacacgccucggcuccaccgcaggcuccggcgccuccguaagcucucucccauccaccgcccgcacccgauccugggucgaagaccaaaacagaaaccucagccccuucaugcgcggagcacacaacauaucauucgucaccccccccuccucccgcucaagcucccaaggcacaguauccacuguucccaaagaaguccuagacuccuggacaggcgccuucaacaccagacgccaaccacuauucgcccacauacgcaaacgcggagaaucccgcgucuaa

SEQ ID NO: 39516 - RNA, 807 nt, Artificial Sequence
  derived and/or modified sequence opt11 from capsid_protein_VP2__Norovirus__AFX81254
auggcgggagcauucuucgccggacuagcgagcgacguccugggcucuggccuaggcucgcucauaaacgcaggcgcaggcgcaaucaaccaaacagucgaguucgaaaacaaccgcaaacuacagcaagcgagcuuccaauucagcucaaaccuacaacaggccucauuccagcacgacaaagaaaugcuacaagcacaaauagaagcaaccaagaaacuacaacaagaaaugaugagggucaaacaagcaauguuacuagaaggcggauucucagaaacggacgcagccagaggcgcaaucaacgccccaaugacaaaaacacucgacuggacaggcacccgcuacugggcgcccgacgccagaaccacaacauacaacgcaggccgcuucuccaccccacaaccgagcggagcccuacccggacgagcaaaccuacgcgccaccguacccgcacgaggcagcucguccacauucucgaacucaagcauagccacaagcguguacuccaaccaaaccacaucaacccgccucggcucaaccgcaggcucgggcacaagcgugagcucacuccccagcacggccaggaccagauccugggucgaagaccaaaacaggaaccugagcccauucaugcgaggggcccacaacaucagcuucgucacgcccccgagcucacgaucaagcucgcaaggaaccgugaguacagucccaaaagaaguccuagacucauggacaggcgcauucaacaccagacgccaaccccuauucgcacacauacgcaagcgaggagaaucacgaguauaa

SEQ ID NO: 39517 - RNA, 807 nt, Artificial Sequence
  derived and/or modified sequence opt11 from capsid_protein_VP2__Norovirus__AFX81257
auggcgggcgcauucuucgccggacucgcaagcgacguacuaggcucaggccugggaucgcucauaaacgcaggcgccggcgcaaucaaccaaaaagucgaguucgaaaacaaccgcaaacuccaacaagcgagcuuccaauucagcucgagccuacaacaggccucauuccagcacgacaaagaaaugcuccaagcgcaaauagaagcaaccaagaaacuacaacaagaaaugaugagagucaaacaagcaaugcugcucgagggcggauucucagaaacagacgcagccaggggagcaaucaacgcaccgaugacgaaaacacucgacuggucaggcacacgcuacugggcgcccgacgcccgaaccacgaccuacaacgcgggcagauucucaaccccgcaaccgagcggggcccuacccgggcgcgcaaaccuacgcgcaaccgugcccgcccgcggauccucuagcacaagcucaaacucaagcauagccacgaguguauacucaaaccagaccacgaguacacgccugggaucaaccgcgggcuccggcacauccgugagcucgcacccaagcacagccagaaccagaagcugggucgaggaccagaacaggaaccugagcccauucaugcgcggggcccacaacauaaguuucgucacgcccccguccucgcgcucaagcucacaaggcaccguaagcacagucccgaaagaaguccuggacucauggacgggcgcauucaacaccagacgccaaccccuauucgcacacauacguaagcgcggggaaucacgcguauaa

SEQ ID NO: 39518 - RNA, 807 nt, Artificial Sequence
  derived and/or modified sequence opt11 from capsid_protein_VP2__Norovirus__AFX81260
auggcgggcgcguucuucgccgggcucgcguccgacguacugggcucgggacuaggaucgcucauaaacgcgggagccggcgcaauaaaccagaaaaucgacuucgaaaacaaccgcaaacuccaacaagcgagcuuccaauucagcucgaaccuacaacaagccucguuccaacacgacaaagaaauguuacaagcgcaaauagaagcaaccaagaaauugcaacaggaaaugaugaaagucaaacaagcgaugcuacuugagggcggcuucucagaaacagacgcggccaggggugcaaucaacgccccaaugacgaaagugcucgacuggucaggcacgcgcuacugggcgcccgacgccagaaccacgaccuacaacgccggcagguucucgaccccgcaaccaagcgggacccugccaggacgcauaaacccacgaacacccacgccagcgcgcgggagcucaagcacaagcucgaacgcgagcacagccaccagcauacacucaaaccagaccgugaguacgcgacugggcucaaccgcgggaucaggcacgaacgugagcucacuaccgagcacggccaggaccaggagcugggucgaagaccagaacagaaaccuaagcccguucaugcgcggggcccacaacaucagcuucgucacgccaccgagcucacgcucaagcucacaaggcaccguaagcacggucccgaaagaaguccuggacucguggacaggagcguucaacaccaggcgccagccccuauucgcccacacaagaagacgcggggaaucgcgcgucuaa

SEQ ID NO: 39519 - RNA, 807 nt, Artificial Sequence
  derived and/or modified sequence opt11 from capsid_protein_VP2__Norovirus__AFX81263
auggcaggcgccuucuucgccggacucgccagcgacguccucggauccggacuaggcucccucaucaacgccggcgccggcgccauaaaccaaaaaaucgacuucgaaaacaaccgcaaacuccaacaagccuccuuccaauucagcuccaaccuacaacaagccucauuccaacacgacaaagaaaugcuacaagcccaaaucgaagccacaaaaaaacuacaacaagaaaugaugaaagucaaacaagccaugcuacucgaaggcggcuucucagaaaccgacgccgcccgcggcgccaucaacgcccccaugacaaaaguccucgacugguccggcacacgauacugggcccccgaugcccgcaccaccaccuacaacgccggccgcuucucuaccccccaacccuccggcacacucccaggccgcauaaacccccgaacccccacccccgcacgcggcuccuccuccacaucaucaaacgcauccaccgccaccuccaucuacuccaaccaaaccguauccacccgccucggcuccaccgccggcuccggcaccaacgucucaucacuccccagcaccgcccgcaccagaagcugggucgaagaccaaaaccgcaaccucuccccauucaugcgaggcgcccacaacaucagcuucguaaccccacccuccucgagauccuccucccaaggaaccguaagcacaguccccaaagaaguacucgacuccuggaccggcgcauucaacacccgccgccaaccccuauucgcccacauccgccgccgcggcgaaucccgcgucuaa

SEQ ID NO: 39520 - RNA, 807 nt, Artificial Sequence
  derived and/or modified sequence opt11 from capsid_protein_VP2__Norovirus__AFX81269
auggccggcgccuucuucgcaggacucgccuccgacguccucggaucaggccucggcucccucauaaacgccggcgccggagcuaucaaccaaaaaaucgacuucgaaaacaaccguaaacuccaacaagccagcuuccaauucuccuccaaccuacaacaagccuccuuccaacacgacaaagaaaugcuccaagcccaaauagaagcuaccaaaaaacuccaacaagaaaugaugaaagucaaacaagccaugcuccucgaaggcggcuucuccgaaaccgacgccgcccgaggcgcaaucaacgcccccaugacaaaaguccucgacugguccggcacccguuacugggcccccgacgcccgcacuaccaccuacaacgccggccgcuucuccaccccccaacccuccggcacccucccaggacgcaucaacccacgcacccccacccccgcucgaggcuccuccuccaccucauccaacgccuccaccgccaccuccaucuacucaaaccaaaccgucuccacccgccucggcuccacagccggcuccggcaccaacguauccucccuccccuccaccgcccgaacccgcuccugggucgaagaccaaaaccgcaaccuaucccccuucaugcgcggcgcccacaacaucuccuuugucaccccccccuccucccgcucuucuucccaaggaaccguauccacuguccccaaagaaguccucgacucauggaccggcgcauucaacacccgccgccaaccccucuucgcacacauccgcagacgcggagaaucacgcgucuaa

SEQ ID NO: 39521 - RNA, 807 nt, Artificial Sequence
  derived and/or modified sequence opt11 from capsid_protein_VP2__Norovirus__AFX81272
auggcaggcgcguucuucgccggacucgcauccgacguacucggcucgggccucggcucccucaucaacgcaggcgcaggcgccaucaaccaaaaaauagacuucgaaaacaaccgcaaacuccaacaagccagcuuucaauucuccucaaaccuccaacaagccucauuccagcacgacaaagaaaugcuccaagcccaaaucgaagccaccaaaaaacugcaacaagaaaugaugaaagucaaacaagccaugcuacuagaaggcggauucuccgaaacagacgcagccagaggcgcaaucaacgccccgaugacaaaaguccucgacuggucaggcacacgcuacugggcacccgacgcccgcaccaccaccuacaacgccggccgauucucgaccccacaaccgagcgggacccuacccggacgcaucaacccccgcacgccaacgcccgcacgcggaagcuccagcaccuccucaaacgcaagcacagccacauccauccacucaaaccaaacaguauccacacgccuaggcuccaccgcaggcucaggcacaaacguauccucacuacccuccacagccagaaccagaagcuggguagaagaccaaaacagaaaccucuccccauucaugcguggagcccacaacaucuccuucgucacaccccccuccucacgcucguccucgcaaggaaccgucagcacaguccccaaagaaguacucgacucauggacaggcgcauucaacaccagacgccaaccccucuucgcccacauccgacggcgcggcgaaucccgcguauaa

SEQ ID NO: 39522 - RNA, 807 nt, Artificial Sequence
  derived and/or modified sequence opt11 from capsid_protein_VP2__Norovirus__AFX81275
auggcaggcgcauucuucgccggacucgcaagcgacguccuaggcuccggccucggcucgcucauaaacgccggagccggcgcaaucaaccaaaagaucgacuucgaaaacaaccgcaaacuccaacaagccuccuuccaauucuccuccaaccuacaacaagccucguuccaacacgacaaagaaaugcuacaagcccaaauagaagccaccaagaaacuccaacaagaaaugaugaaagucaaacaagcaaugcuacucgaaggcggauucucagaaacagacgcggcccgaggcgccaucaacgccccaaugacgaaaguacuagacugguccggcacacgauacugggcacccgacgccagaaccacaaccuacaacgcaggcagauucucaacaccccaaccgagcggaacccuacccggccgcauaaacccccgcacgccaacacccgcacgcggcagcuccagcacauccucaaacgcaagcacggccacauccauauacucaaaccaaaccguaagcacacgccuaggcuccaccgcaggaucaggcacgaacguaagcucacuccccuccaccgccagaaccaggagcugggucgaagaccaaaaccgaaaccuaucccccuucaugcgcggagcccauaacaucagcuucgucacacccccaagcucacgaucaagcucccaaggaaccgucagcacagucccaaaagaaguccuugacuccuggacaggagcauucaacaccagacgccagccacuauucgcacacauacgccgacgcggagaaucacgcgucuaa

SEQ ID NO: 39523 - RNA, 807 nt, Artificial Sequence
  derived and/or modified sequence opt11 from capsid_protein_VP2__Norovirus__AFX81278
auggcaggagcguucuucgccgggcucgcgagcgacguacugggcucaggccugggcucacucauaaacgcgggcgccggcgcgauaaaucagaaaaucgacuucgagaacaaccgcaagcuccaacaagcgagcuuccaauucagcucaaaccuacaacaggccucauuccagcacgacaaagagaugcuacaagcgcaaaucgaagccacaaagaaacuacaacaggaaaugaugaaggucaagcaagcaaugcuacucgagggcggauucucagaaacggacgcggcccgaggcgcgaucaacgcaccaaugacaaaaguacucgacugguccggcacgcguuacugggcgccugacgccagaaccacgaccuacaacgcgggcagguucucaaccccgcaaccgagcggaacccugcccggacgcauaaacccgcgcacgcccacacccgcgcgcgggagcucgagcacaagcucgaacgcgagcacagccacgagcauauacucaaaccagaccgugagcacacgccugggcucaaccgcaggcucaggcacaaacguaagcucacucccaagcacggccaggacccgaaguugggucgaggaccagaacaggaaccugagcccguucaugcgcggggcccacaacaucagcuucgucacgcccccaagcucgagaucaagcucccaagggaccguaagcacagucccgaaagaaguccuggacucguggacgggcgcguucaacaccaggcgccagccccuauucgcccacauacgcaggcgcggagaaucgcgcguguga

SEQ ID NO: 39524 - RNA, 807 nt, Artificial Sequence
  derived and/or modified sequence opt11 from capsid_protein_VP2__Norovirus__AFX81281
auggccggcgccuucuucgccggccucgccagcgacguccuaggcuccggacuuggcucacucaucaacgcaggcgccggagccaucaaccaaaaaaucgacuucgaaaacaaccgcaaacuccaacaagccuccuuccaauucagcucgaaccuccaacaagccuccuuccaacacgacaaagaaaugcuccaagcccaaaucgaagccaccaaaaaacuccaacaagaaaugaugaaaguaaaacaagccaugcuacucgaaggcggcuucucugaaaccgacgccgccagaggagccaucaacgcacccaugaccaaaguccucgacuggucaggcacacgcuacugggcccccgacgcccgcaccaccaccuacaacgcaggccgauuuucaaccccccaacccuccggcgcccucccaggacgcaucaacccacgcacaccaacccccgcacgcggauccucauccaccuccucuaacgccucaaccgccaccuccauacacuccaaccaaaccgucuccacacgacuaggcuccaccgcaggcuccggcaccaacguaagcucccuacccuccacagccagaacccgcucaugggucgaagaccaaaaccgcaaccuaucccccuucaugcgcggagcccacaacaucuccuucgucaccccccccuccucacgauccagcucccaaggcaccgucuccaccguccccaaagaaguccucgacuccuggaccggcgcauucaacacccgccgccaaccccucuucgcucacauccgucgccgcggagaaucccgagucuaa

SEQ ID NO: 39525 - RNA, 807 nt, Artificial Sequence
  derived and/or modified sequence opt11 from capsid_protein_VP2__Norovirus__AFX81284
auggcuggcgcguucuucgccggacucgcaagcgacguacugggcucaggcuuggguucacucauaaacgcgggcgcaggcgcgauaaaccagaaaaucgacuucgagaacaaccgcaagcuccaacaagcguccuuccaauucagcucgaaccuacaacaagcaucguuccagcacgacaaagagaugcugcaagcgcaaauagaagcgaccaagaaauugcaacaggaaaugaugaaagucaaacaagcgaugcugcucgagggcggauucuccgaaacggacgcggccaggggagcaaucaacgccccaaugacgaaagugcucgacuggucgggcacgcgcuacugggcgcccgacgccaggaccacaaccuacaacgcgggccgguucucaaccccgcaaccaagcgggacacugcccgggagaauaaacccgcgcacgcccacgcccgcacgagggagcucgagcacgagcucaaacgccagcacggccacaagcauauacucgaaccagaccguaagcacgcgccugggcucgaccgcgggcucaggcacgaacgugagcucgcucccaagcacagccaggaccagaucaugggucgaggaccaaaacaggaaccuaaguccauucaugcgcggggcccacaacaucagcuucgucacacccccgagcucgcgcucgagcucgcaaggaaccguaagcacagucccgaaagagguccuagacucauggacgggcgcauucaacacccggcgccaacccuuguucgcgcacauacgccgccgcggagaaucgcgcguauga

SEQ ID NO: 39526 - RNA, 807 nt, Artificial Sequence
  derived and/or modified sequence opt11 from capsid_protein_VP2__Norovirus__AFX81287
auggcgggcgcguucuucgccggacuagcaagcgacguccuaggcucaggccuaagcucgcucauaaacgcaggcgcaggcgcgaucaaccaaaaaauagacuucgaaaacaaccgcaaacuccaacaagcaagcuuccaauucagcucaaaccuacaacaagccucauuccaacacgacaaagagaugcuacaagcacaaauagaagcaaccaaaaaacugcaacaggaaaugaugaaagucaaacaagcaaugcuucucgaaggcggauucucagaaacagacgcagccaggggugcaaucaacgccccaaugacgaaaguccuagacuggucgggcacacgcuacugggcgcccgacgccagaaccacaaccuacaacgccggcagauucucgaccccacaaccgagcggaacccuaccaggccgcaucaacccucgcacacccacacccgcgcgaggaagcucaagcacaagcucaaacgcacccacagccacaagcauacacuccaaccaaaccguaagcacacgccuaggcucaaccgcaggcucaggcacaaacguaagcucacuccccagcacagccagaacccgaagcugggucgaagaccaaaacagaaaccucagcccauucaugcgaggcgcccacaacaucagcuuugucacgcccccaagcucccgcuccagcucacaaggaaccguaagcacggucccaaaagaaguccuggacucauggacaggcgcauucaacacccggcgccagccccuguucgcgcacauccgaagacgcggagaaucacgcguguaa

SEQ ID NO: 39527 - RNA, 807 nt, Artificial Sequence
  derived and/or modified sequence opt11 from capsid_protein_VP2__Norovirus__AFX81290
auggccggcgccuucuucgccgggcucgcgucagacguccuaggcuccggacucggcucacucaucaacgcgggcgcaggcgccaucaaccaaaaaaucgacuucgaaaacaaccgcaaacuacaacaagccagcuuccaauucuccucaaaccuccaacaagccucauuccaacacgacaaagaaaugcuccaagcccaaaucgaagccaccaaaaaacuccaacaagaaaugaugaaagucaaacaagcaaugcuccucgaaggcggcuucuccgaaaccgacgcagcccgaggcgccaucaacgcccccaugaccaaaguccucgacuggucaggcacccgcuacugggccccagacgcacgcaccacaacauacaacgccggccgcuucucaaccccccaacccuccggcacccuccccggccgcaucaacccccgcacgcccacaccagcgcguggaagcuccuccaccuccuccaacgccagcaccgccacaagcaucuacucaaaccaaaccguauccacacgccuaggcuccaccgcaggcuccggcacaaacgucuccucccuccccagcaccgcccgcaccagaagcugggucgaagaccaaaaccgcaaccuuagcccauucaugcgcggagcccacaacaucuccuucgucacccccccauccucacgcuccuccucccaaggaaccguauccaccgucccaaaagaaguccuggacuccuggacaggcgccuucaacacccgccgccaaccccuuuucgcccacauccgccgccgcggcgaaucacgcguauaa

SEQ ID NO: 39528 - RNA, 807 nt, Artificial Sequence
  derived and/or modified sequence opt11 from capsid_protein_VP2__Norovirus__AFX81293
auggccggcgcauucuucgccggccucgccuccgacguccucggcuccggccucggcucccucaucaacgcaggcgcaggcgccaucaaccaaaaaauagacuucgaaaacaaccgcaaacuccaacaagcauccuuccaauucuccuccaaccuccaacaagccuccuuccaacacgacaaagaaaugcuacaagcacaaauagaagccaccaaaaaacuacaacaagaaaugaugaaagucaaacaagccaugcuccuagaaggaggcuucucagaaaccgacgccgcccgcggagccaucaacgccccaaugaccaaaguccucgacugguccggaacacgcuacugggcacccgacgcccgcaccaccaccuacaacgcuggccgauucuccaccccccaacccuccggcacccuccccggucgaauaaacccccgcacacccacccccgcacgaggauccuccuccacauccuccaacgccuccaccgccacauccauccacuccaaccaaaccgucuccacucgccuaggcuccaccgccggauccggcacaaacgucuccucccuccccuccaccgcccgcacccgcuccuggguagaagaccaaaaccgaaaccucuccccauucaugcgcggagcccacaacaucuccuucguaaccccccccuccucccgcuccuccucccaaggcaccgucucaaccgucccaaaagaaguccucgacuccuggacaggcgccuucaacacacgccgacagccccucuucgcccacauccgcagaagaggcgaaucccgcgucuaa

SEQ ID NO: 39529 - RNA, 807 nt, Artificial Sequence
  derived and/or modified sequence opt11 from capsid_protein_VP2__Norovirus__AFX81296
auggcaggagcguucuucgccgggcucgcaagcgacguccugggcucgggccuaggcucgcucauaaacgcgggagcaggcgcaauaaaccagaaaaucgacuucgagaacaaccgcaagcuccaacaagcgagcuuccaauucaguucgaaccuacaacaggcaucauuccagcacgacaaagagaugcugcaagcacaaauagaagcaaccaagaaacugcaacaggaaaugaugaaggucaagcaagcgaugcuacucgagggcggauucuccgaaacggacgcggccaggggcgcgaucaacgccccgaugacgaaaguacucgacuggucaggcacacgcuauugggcgcccgacgcccgaacaacgaccuacaacgcgggcagguucucaacuccgcaaccgagcggaacccuacccgggcgcgugaacccgcgcacgcccacgcccgcacgcgggagcucgagcacaagcucaaacgcgagcacggcaacaagcauacacucgaaccagaccgugagcacgcgcuugggcucaaccgcgggcucgggcacaaacguaagcucacucccaagcacggccaggacaagaagcugggucgaagaccagaacagaaacuuaagcccguucaugcgcggcgcccacaacaucagcuucgucacgcccccgagcucgcgcucaagcucacaaggaaccgugagcacaguaccgaaagagguccuggacucguggaccggcgcguucaacaccaggcgccagcccuuauucgcccacauacgcaggcgcggggaaucgcgcguauaa

SEQ ID NO: 39530 - RNA, 807 nt, Artificial Sequence
  derived and/or modified sequence opt11 from capsid_protein_VP2__Norovirus__AFX81299
auggcgggcgcguuuuucgccgggcucgcgagcgauguccugggcucgggccugggcucgcucauaaacgcgggcgcaggcgcgauaaaucaaaagaucgacuucgagaauaaccgcaagcuacagcaagcgaguuuucaauuuagcucgaaccugcaacaggccucguuccagcacgauaaagaaaugcugcaagcgcaaauagaagcaaccaagaaacugcaacaggaaaugaugaaagucaagcaagcaaugcugcuagagggcggauucucggaaacggacgcggccagaggcgcaaucaacgccccgaugacgaaagugcucgacuggucaggcacacgcuauuggacgcccgacgcccggaccacgaccuacaacgcgggcagguucucgaccccacaaccgagcgggacccuacccgggcgcauaaacccgcgcacacccacgcccgcgcgcggaagcucgagcacaagcucgaacgcaagcacagccacgagcauacacucgaaccagaccguaagcacgcgccuaggaucgaccgcgggcucgggcacgaacgugagcucgcucccaagcacggccagaacaaggagcugggucgaggaccaaaacaggaacuugagcccguucaugcgaggggcccacaacaucagcuucgucacgcccccgagcucgcgauccaguucgcaagggaccgugagcacgguaccgaaagagguccuggacucauggacaggcgcauucaacaccaggcgccaacccuuguucgcgcacauacgcaggcgcggggaaucgcgcguguga

SEQ ID NO: 39531 - RNA, 807 nt, Artificial Sequence
  derived and/or modified sequence opt11 from capsid_protein_VP2__Norovirus__AFX81302
auggcaggcgcauucuucgccggccucgccagcgacguacuauccuccggccucggcucacucaucaacgccggcgccggcgcaaucaaccaaaagaucgacuucgaaaacaaccgcaaacuccaacaagccucauuccaauucagcucuaaccuccaacaagccuccuuccaacacgacaaagaaaugcuccaagcacaaaucgaagcuaccaaaaaacuccaacaagaaaugaugaaagucaaacaagccaugcuccucgaaggcggauucuccgaaaccgacgccgcccgaggcgccaucaacgccccuaugacaaaagcccucgacugguccggaacacgcuacugggccccagaugcccgcaccaccaccuacuccgccggccgauucuccaccccccaacccuccggcgcauuacccggccguacaaacccacgcgcacccauacccgcacgcggcucccccuccacauccuccggcgcauccaccgccacauccauauacuccaaccaaaccgucuccacacgccucggcuccaccgccggauccggcaccaacgucuccucccuacccuccaccgcccgcacacgcuccugggucgaagaccaaaaccgcaaccucucaccauucaugcgcggcgcccacaacaucuccuucgucacccccccauccucccgcucuagcucccaaggaaccgucuccacaguccccaaagaaguccuagacuccuggaccggagccuucaacacacgacgccaaccccuauucgcccacauccgccgacgcggcgaaucccgcguuuaa

SEQ ID NO: 39532 - RNA, 807 nt, Artificial Sequence
  derived and/or modified sequence opt11 from capsid_protein_VP2__Norovirus__AFX81305
auggccggagcauucuucgccggccuagccuccgacguccucggcuccggccucggcucccuaaucaacgccggcgccggcgccaucaaccaaaaaaucgacuucgaaaacaaccgcaaacuucaacaagccagcuuccaauucuccuccgaccuccaacaagccuccuuccaacacgacaaagaaaugcuacaagcccaaaucgaagccaccaaaaaacuccaacaagaaaugaugaaagucaaacaagcaaugcuucuagaaggcgguuucuccgaaacagacgccgcccgcggcgccaucaacgccccaaugaccaaaguccucgacuggucaggcacccgcuacugggcccccgacgcccgcaccaccaccuacucagcuggccgcuucucaaccccccaacccuccggaacccucccaggccgcaccaacccccgcaccccaacccccgcccgcggcuccuccuccaccuccuccaacgcauccaccgccaccuccauccacuccaaccaaaccguaucaacccgccucggcuccaccgccggcuccggaaccaacguauccucccuccccucuaccgcccgaacccgauccuggguagaagaccaaaaccgcaaccucucacccuucaugcgaggcgcccacaacauaucauucgucacaccacccucaucacgcuccucaucccaaggcaccgucuccaccgucccaaaagaaguccucgacuccuggaccggcgcuuucaacacacgccgccaaccacucuucgcccacauccgccgccgcggcgaaucccgcgucuaa

SEQ ID NO: 39533 - RNA, 807 nt, Artificial Sequence
  derived and/or modified sequence opt11 from capsid_protein_VP2__Norovirus__AFX81308
auggcaggcgcguucuucgccggacucgcgagcgacguccugggcucaggccugggcucgcucauaaacgcaggcgcaggcgcaaucaaccaaaagauagacuucgagaacaaccgaaaacuccagcaagcauccuuccaauucagcucaaaccuacaacaggccucguuccaacacgacaaagagaugcugcaagcacaaauagaagcaaccaagaaacugcaacaagaaaugaugaaggucaaacaagcaaugcuacucgaaggcggguucucggaaacggacgcagccaggggcgcgauuaacgccccgaugaccaaaguacucgacuggucaggcacgcgcuacugggcacccgacgccaggaccacgaccuacaacgcaggcagguucucaaccccacaaccaaguggaacccuccccgggcgcauaaacccgcgcacgcccacgcccgcacgcggaagcucaagcacgagcucgaacgcgagcacagccacaagcauacacucgaaccagaccgugagcacgcgccuaggcuccacugcgggcucaggcacaaacgugagcucgcucccgagcacagcaagaaccaggagcugggucgaagaccagaacaggaaccuaagcccauucaugcgcggagcccacaacaucagcuucgucacgcccccguccucccgcucaagcucacaagggacaguguccacaguaccgaaagaaguccuggacucauggacgggcgcguucaacaccagacgccagccccuguucgcgcacauacgcaggcgcggagaaucacgcguauaa

SEQ ID NO: 39534 - RNA, 807 nt, Artificial Sequence
  derived and/or modified sequence opt11 from capsid_protein_VP2__Norovirus__AFX81311
auggcaggcgcauucuucgccggacuagcaagcgacguccucggcuccggccucggcucacucaucaacgcaggcgcgggcgcaaucaaccaaaaaaucgacuucgaaaacaaucgcaaacuccaacaagccagcuuccaauucagcucaaaccuacaacaagccucauuccaacacgacaaagaaauguuacaagcacaaauagaagcaaccaagaaacuacaacaagaaaugaugaaagucaaacaagcgaugcuacucgaaggcggcuucucagaaacagacgccgccagaggugcaaucaacgccccaaugaccaaaguccucgacugguccggcacacgcuacugggcgcccgacgccagaacaaccaccuacaacgcaggaagguucucaacaccacaacccagcggaacccuccccggaagaauaaacccacgcacacccacacccgcacgaggaagcucauccaccuccucaaacgcaagcacggccacaagcauauacucgaaccaaaccgucagcacacgccuaggcucgaccgcaggauccggcaccaacgucagcucccucccauccaccgccagaaccagaagcugggucgaggaccaaaacagaaaccugagcccauucaugcgcggggcacacaacauaagcuucgucacaccaccaagcucacgcucaagcucacaaggaaccguaagcacaguccccaaagaaguccuggacuccuggaccggcgccuucaacacccgacgccaaccccuauucgcccacauacgcagacgcggagaaucccgcguguga

SEQ ID NO: 39535 - RNA, 807 nt, Artificial Sequence
  derived and/or modified sequence opt11 from capsid_protein_VP2__Norovirus__AFX81314
auggcaggcgccuucuucgccggccucgcauccgacguccuaggcuccggccuaggcucccucaucaacgccggcgcaggcgccauuaaccaaaaaaucgacuucgaaaacaaccgcaaacuacaacaagccagcuuccaauucagcuccaaccuccaacaagccuccuuccaacacgacaaagaaaugcugcaagcacaaauagaagccaccaaaaaacuccaacaagaaaugaugaaagucaaacaagccaugcuccucgaaggcggcuucucagaaaccgacgcagcccgcggcgccaucaacgcccccaugaccaaaguccucgacugguccggcacacgcuacugggcucccgacgcccgaaccaccaccuacaacgccggccgauucucaaccccccaacccagcggcacccuccccggccgcauaaacccaagaacacccacccccgcccgaggcagcucauccaccagcuccaacgcauccaccgccaccagcauccacucaaaccaaaccguaagcacccgccucggcuccaccgcaggcuccggcaccaacgugagcucacuccccaguaccgcccgaacccgcagcuggguugaagaccaaaaccgaaaccuguccccauucaugcgcggagcacacaacaucuccuucgucaccccccccuccucacgcuccuccucacaaggcaccgucuccacaguaccaaaagaaguacuggacucauggaccggcgcauucaacacccgccgacaaccccuauucgcccacauccgccgccgcggggaaucacgcgucuaa

SEQ ID NO: 39536 - RNA, 807 nt, Artificial Sequence
  derived and/or modified sequence opt11 from capsid_protein_VP2__Norovirus__AFX81317
auggccggcgcauucuucgccggacucgccagcgacguccucggcucaggccuaggcucacucaucaacgcaggcgcaggcgccaucaaccaaaaaaucgacuucgaaaacaaccgcaaacuccaacaagcaagcuuccaauucuccucaaaccuccaacaagccucauuccaacacgacaaagaaaugcuccaagcacaaauagaagccaccaagaaacuccaacaagaaaugaugaaagucaaacaagcaaugcuccucgaaggcggauucuccgaaaccgacgcggccagaggcgcaaucaacgccccaaugacuaaaguacuagacugguccggcacacgcuacugggcacccgacgcccgcaccaccaccuacaacgcaggccgcuucucgacaccccaacccuccggaacccuacccggacgcauaaacccccgcacaccaacaccagcacgcggcagcucaagcaccagcuccaacgcaagcaccgccaccagcauacacucaaaccaaaccgucuccacccgccuaggcucaaccgcaggcucaggcacaaacgucuccucacuccccagcaccgcccgaaccagaagcugggucgaagaccaaaaccgaaaccucagcccauucaugcgcggcgcccacaacauauccuucgucaccccccccagcucgcgcucaagcucgcaaggaacagucagcacagucccgaaagaaguccuagacucguggacaggcgccuucaacaccagacgccaaccccuguucgcacacauacgcagacgcggagaaucgcgcguauaa

SEQ ID NO: 39537 - RNA, 807 nt, Artificial Sequence
  derived and/or modified sequence opt11 from capsid_protein_VP2__Norovirus__AFX81320
auggccggcgccuucuucgccgggcucgccagcgacguccucggcucaggccucggcucacucaucaacgccggcgcaggcgccaucaaccaaaaaaucgacuucgaaaacaaccgcaaacuccaacaagccuccuuccaauucuccuccaaccuccaacaagccuccuuccaacacgacaaagaaaugcuacaagcacaaauagaagccacaaaaaaacuccaacaagaaaugaugaaagucaaacaagcaaugcuccucgaaggaggcuucucagaaaccgacgccgcccgcggcgccaucaaugcccccaugacaaaagugcucgacugguccggcacccgcuacugggcacccgacgcccgaaccaccaccuacaacgccggccgcuucuccaccccacaaccauccggcacccugcccggacgcaucaauccacgaacccccacccccgcaagaggcagcucgagcacaagcuccaaugcaagcaccgccaccagcauccacucaaaccaaaccgucagcacccgccucggcuccaccgcaggcuccggcacaaacguaagcucacucccgagcaccgccagaacccgauccugggucgaagaccaaaaccgcaaccuaagcccauucaugcgcggcgcccacaacaucagcuucgucacacccccauccucccgauccagcucacaaggcacagucuccaccguccccaaagaaguccuagacucauggacaggcgcauucaacacacgcagacaaccacucuucgcccacauccgccgacgcggcgaaucccgcgucuaa

SEQ ID NO: 39538 - RNA, 807 nt, Artificial Sequence
  derived and/or modified sequence opt11 from capsid_protein_VP2__Norovirus__AFX81323
auggcaggagcauucuucgccggacucgcaagcgacguccucggcucaggccucggcagccucauaaacgcaggcgccggagcaaucaaccaaaaaaucgacuucgagaacaaccgaaaacuacaacaagcaagcuuccaauucuccucgaaccuccaacaagccucauuccaacacgacaaagaaaugcuacaagcacaaaucgaagccaccaaaaaacuccaacaagaaaugaugaaaguaaaacaagcaaugcuccucgaaggaggauucuccgaaacggacgccgccagaggcgcaaucaacgcacccaugacaaaaguacucgacugguccggcacacgcuacugggcacccgacgccagaaccacaaccuauagcgcaggcagauucucgaccccacaaccauccggaacccugccaggacgcauaaacccacgcacacccacacccgcacgcggcagcucauccacaagcucgaacgcauccaccgccacaagcauacacucaaaccaaaccguaagcacgcgccucggcucaacagcaggcucaggcacgaacguaagcucacucccgagcaccgccagaacccgaagcuggguagaagaccaaaacagaaaccuaagcccauucaugcgaggcgcccacaacauuagcuucgucacacccccaagcucacgcucaagcucacaaggaaccguauccacagucccaaaagaaguccucgacucauggacaggagcauucaacaccagacgccaaccccuauucgcccacauacgccgacgcggcgaaucccgcguauaa

SEQ ID NO: 39539 - RNA, 807 nt, Artificial Sequence
  derived and/or modified sequence opt11 from capsid_protein_VP2__Norovirus__AFX81326
auggcaggagcguucuucgccggacucgcaagcgacguccuaggcucaggccuaggcucacucauaaacgcgggcgccggcgcaaucaaucagaaaauagacuucgaaaacaaccgcaaacuccaacaagccagcuuccaauucagcucaaaccugcaacaagcaucguuccaacacgacaaagaaaugcuacaagcgcaaauagaagccaccaagaaacugcaacaagaaaugaugaaagucaaacaagcaaugcuacucgaaggcggauucucagaaaccgacgcggcccgaggcgcaaucaacgccccaaugaccaaaguccuagacuggucaggcacacgauacugggcgcccgacgcccgaaccaccaccuacaacgcgggcagguucucaaccccacaaccaucaggaacacuacccggacgcaucaacccacgcacaccaacacccgcgcgcggaagcucaagcacaagcucgaacgcaagcacggccacaagcaucuacucaaaccaaaccguaagcacccgccuaggaucaaccgccggcucaggcacaaacgugagcucacucccaagcacagccagaaccagaagcugggucgaagaccaaaaccgaaaccuaagcccauucaugcgcggggcccauaacaucagcuucgucacgcccccaagcucccgauccuccucacaaggaaccguaagcacaguaccaaaagaaguccuggacucauggacaggcgcauucaacaccaggcgccaaccccuguucgcccacauacgcaggcgcggagaaucacgaguauaa

SEQ ID NO: 39540 - RNA, 807 nt, Artificial Sequence
  derived and/or modified sequence opt11 from capsid_protein_VP2__Norovirus__AGE89434
auggcgggcgcguucuucgccgggcucgcgagcgauguacuaggcucaggccugggcucacucauaaacgcgggcgcaggcgcgauaaaccaaaagaucgacuucgagaacaaccgcaagcuccaacaagccagcuuccaauucagcucgaaccugcaacaggcaucguuccagcacgacaaagagaugcugcaagcacaaauagaagcgaccaagaaauugcaacaggaaaugaugaaggucaagcaagcgauguugcucgagggcggauucucggaaacggacgcggccagaggcgcgaucaacgccccgaugacgaaagugcucgacuggucgggcacgcgcuacugggcgcccgacgccaggacaacaaccuacaacgcgggcagauucucgaccccgcaaccaagcgggacccuacccggacgcauaaacccgcgcacgcccacacccgcgcgcggaagcucgagcacaaguucaaacgcgagcacggccacaagcauacacucgaaccagaccguaagcacgcgccugggcucgaccgcgggcuccggcacgaacguaaguucgcucccgagcacagcaagaaccaggagcuggguagaagaccagaaccggaaccuaagcccguucaugcgcggcgcccacaacaucagcuucgucacgcccccaagcucgcgcuccagcucgcaaggaaccguaaguacggucccgaaagagguccuggacuccuggacaggagccuucaacacaaggagacagccccucuucgcacacauacgaagacgcggagaaucgcgcgucuaa

SEQ ID NO: 39541 - RNA, 807 nt, Artificial Sequence
  derived and/or modified sequence opt11 from capsid_protein_VP2__Norovirus__AGE89437
auggcaggcgcauucuucgccgggcucgcgagcgacguccugggcucaggccuaggcucacucauaaacgccggcgcaggcgcgauaaaccagaaaaucgacuucgagaacaaccgcaagcuccaacaagcauccuuccaauucagcucaaaccuacaacaagccucauuccaacacgacaaagaaaugcuacaagcacaaauagaagcaaccaagaaacuacaacaggaaaugaugaaaguaaaacaagcaaugcuacucgaggguggauucucagaaacagacgcggccagaggcgcgaucaacgcaccaaugacaaaaguacucgacuggucgggcacgcgcuacugggcgcccgacgccagaaccacaaccuacaacgcgggcagauucucgaccccacaaccaagcggaacacugcccggacgaauaaacccacgcacacccacacccgcacgaggaagcucgagcacaagcucaaacgcaagcacagccacaagcauacacuccaaccaaaccgugagcacccgccuaggaucaaccgcgggcucaggcacaaacgucagcucacucccaagcaccgccagaaccagaagcugggucgaggaccagaacaggaaccugagcccguucaugcgaggggcccacaacaucagcuucguaacacccccguccucacgaucaagcucgcaaggaaccguaagcacagucccaaaagagguccuagacucguggacgggcgcguucaacaccagacgacagccccuauucgcgcacauacgcagacgcggggaaucacgcguauga

SEQ ID NO: 39542 - RNA, 807 nt, Artificial Sequence
  derived and/or modified sequence opt11 from capsid_protein_VP2__Norovirus__AGE89440
auggcaggcgcauucuucgccgggcucgccuccgacguccugggcuccggacucggcucacuaaucuccgccggcgcgggcgccaucaaccaaaaagucgaauucgaaaacaaccgaaaacuccaacaagccucauuccaauucagcucgaaccuccaacaagcauccuuccaacacgacaaagaaaugcuacaagcccaaauagaagcaaccaaaaaacuacaacaagaaaugaugcgcgucaaacaagcaaugcugcucgaaggcggauucucagaaaccgacgccgcccgcggcgccaucaacgcccccaugaccaaaacccucgacugguccggcacccgauacugggcccccgacgccaggaccaccaccuacaacgcaggccgcuucuccacaccacaaccaagcggcgcccuccccggccgcgccaaccuaagagcaaccguaccagcacgcggauccuccagcaccuucuccaacucgagcaucgcaacauccgucuacuccaaccaaaccaccuccacacgacucggcucaaccgccggaucaggcacgagcguaagcucacucccaagcacagcccgcacccgaagcugggucgaagaccaaaacagaaaccuaagcccauucaugcgcggcgcacauaacaucagcuucgucaccccaccauccucccgcuccagcucacaaggaaccgucuccaccguccccaaagaaguccuagacucauggacaggcgcauucaacaccagacgccaaccccuguucgcacacauccgaaaacgcggcgaaucgcgcgucuaa

SEQ ID NO: 39543 - RNA, 807 nt, Artificial Sequence
  derived and/or modified sequence opt11 from capsid_protein_VP2__Norovirus__AGE89443
auggccggagcauucuucgccggccuagccuccgacguccucggcuccggccuaggcucccuaaucaacgccggcgccggcgcaaucaaccaaaaagucgaauucgaaaacaaccgcaaacuccaacaagcauccuuccaauucuccucaaaccuccaacaagccucauuccaacacgacaaagaaaugcuccaagcccaaaucgaagccaccaaaaaacuccaacaagaaaugaugagagucaaacaagcgaugcuccucgaaggcggcuucucagaaacagacgccgcccgaggcgccauaaacgcccccaugaccaaaacacucgacuggucaggcacccgcuacugggcccccgacgccagaaccacaaccuacaacgccggccgauucuccacuccccaacccuccggcgcccuccccggacgcgccaaccuccgcgccaccguacccgcccguggcuccuccuccaccuccuccaacgcauccauagccaccagcgucuacuccaaccaaaccacauccacacgacucggcuccaccgcaggcucaggcaccucagucuccucccuccccuccacagcccgcacccgcuccugggucgaagaccaaaacagaaaccuaucaccauucaugcgaggagcccacaacauuuccuucgucaccccacccuccucccgcuccuccucccaaggcaccguauccaccguccccaaagaaguccuagacuccuggaccggagccuucaacacccgccgccagccccucuucgcccacauccgcaaacgcggcgaaucccgcgucuaa

SEQ ID NO: 39544 - RNA, 807 nt, Artificial Sequence
  derived and/or modified sequence opt11 from capsid_protein_VP2__Norovirus__AGE89449
auggcaggcgcguucuuugccgggcucgcaagcgacguccugggcucaggccugggcucgcucauaaacgcgggcgcgggcgcaauaaaccaaaaaguagaguucgagaacaaucgcaagcuccagcaagcgagcuuccaauucagcucgaaccuacaacaggccucguuccaacacgacaaagagaugcugcaagcacaaauagaagccaccaagaaacugcaacaggaaaugaugagagucaaacaagcgaugcugcucgagggcggguucucggaaacggacgcagccagaggcgcgaucaacgccccgaugacgaaaacacucgacuggucaggcacacgcuacugggcacccgacgcccgaaccacgaccuacaacgcgggacgauucucgacaccgcaaccaagcgggguacuacccgggcgcgcaaaccuacgcgcaaccgugcccgcgcgcggaaguucgagcacauucucaaacucauccaucgccacaaguguauacucgaaccaaaccacaagcacgcgccugggcucgaccgcgggcucgggcacgagcgucaguucacucccgagcacggccaggaccaggagcuggguagaggaccaaaacaggaaccugagcccauucaugcgcggagcccacaacaucagcuucgucacgcccccgagcucacgcucauccucgcaagggaccgugagcacggucccgaaagagguccuggacucguggacgggcgcauucaacaccagacgccagccccuguucgcgcacauacgaaagcgcggggaaucccgaguguaa

SEQ ID NO: 39545 - RNA, 807 nt, Artificial Sequence
  derived and/or modified sequence opt11 from capsid_protein_VP2__Norovirus__AGE89455
auggcaggagccuucuucgccggccuagccuccgacguccucggcuccggccucggcucccuuauaaacgccggcgccggcgccaucaaccaaaaaaucgacuucgaaaacaaccgcaaacuccagcaagccagcuuccaauucucauccaaccuacaacaggccucauuccaacacgacaaagagaugcuacaagcccaaauagaagcaaccaaaaaacuccaacaagaaaugaugaaagucaaacaagccaugcuacucgaaggcggauucuccgaaaccgacgcagcucgaggcgccaucaacgcccccaugacaaaaguccucgacugguccggcacccgcuacugggcccccgacgcccgcaccacaacauacaacgcaggccgcuucuccaccccccaacccagcggcgcccuaccaggccgcaucaacccccgcacccccacucccgcacgcggcuccucaagcaccuccuccaacgcauccaccgccacauccauccacuccaaccaaaccgucuccacccgccucggaucaaccgccggcucaggcaccaacgucuccucacuucccagcacagccagaaccagauccugggucgaagaccaaaaccgaaaccuuucccccuucaugcgcggcgcccacaacaucuccuucgucacccccccuuccucacgcuccagcucccaaggaaccguaucaaccguccccaaagaaguccucgacucauggacaggcgcauucaacacccgccgccaaccccuauucgcacacauccgacgccgcggagaaucccgcgucuaa

SEQ ID NO: 39546 - RNA, 807 nt, Artificial Sequence
  derived and/or modified sequence opt11 from capsid_protein_VP2__Norovirus__AGE89458
auggccggagcauucuucgccggacucgcauccgacguccucggcucaggccucggaucccucauaaacgcaggcgccggcgcaauaaaccaaaaaauagacuucgaaaacaaccgcaaacuccaacaagcaagcuuccaauucucaucaaaccuccaacaagccuccuuccaacacgacaaagaaaugcuccaagcccaaaucgaagccacaaaaaaacuccaacaagaaaugaugaaagucaaacaagccaugcuacucgaaggcggauuuucggaaaccgacgcagcacgaggcgcaaucaacgcccccaugaccaaaguccucgacugguccggcacccgcuacugggcacccgacgcccgaaccacaaccuacaacgccggccgauucuccaccccacaaccauccggcacacuacccggacgcaucaacccccgaaccccaacccccgcccgaggauccuccuccaccagcucaaacgcauccacagccacauccauccacucgaaccaaaccguuuccacacgccuaggcucaaccgccggcuccggaacaaacguauccucacucccauccaccgccagaacccgcuccugggucgaagaccaaaacagaaaccucuccccauucaugcgaggcgcccacaacaucagcuucguaacacccccauccucccgcucguccucccaaggaaccguauccacaguccccaaagaaguccuagacucauggacgggcgcguucaauacccgacgucaaccccucuucgcccacauccgccgccgcggcgaaucacgcgucuaa

SEQ ID NO: 39547 - RNA, 807 nt, Artificial Sequence
  derived and/or modified sequence opt11 from capsid_protein_VP2__Norovirus__AGE89461
auggcaggcgccuucuucgccggacuagccuccgacguccucggcuccggccucggcucccucauaaacgcaggcgcaggcgcaaucaaccaaaaaaucgauuucgaaaacaaccgcaaacuacaacaagccuccuuccaauucuccuccaaccuccaacaagccuccuuccaacacgacaaagaaaugcuacaagcccaaaucgaagccaccaaaaaacuccaacaagaaaugaugaaagucaaacaagcaaugcuacucgaaggcggcuucucagaaaccgacgccgcccgcggcgccaucaacgcccccaugacaaaaguccucgacuggucaggcacacgcuacugggcccccgacgcccguaccaccacauacaacgcaggacgauucuccaccccacaacccuccggaacccuaccaggccgcaucaacccaagaacccccacccccgcccgcggcagcucaagcacauccucaaacgccuccaccgccaccuccaucuacucuaaccaaaccgucuccacacgccucggcucgaccgccggcuccggcaccaacguauccucccuccccuccaccgcccgcacccgguccugggucgaagaccaaaaccgaaaccucucccccuucaugcgaggagcccacaacaucuccuucgucacuccccccuccucccgcuccuccucucaaggaacagucagcaccgucccaaaagaaguccuagacuccuggaccggcgccuucaacacccgccgccaaccccuauucgcccacauccgcagacgcggcgaaucccgcgucuaa

SEQ ID NO: 39548 - RNA, 807 nt, Artificial Sequence
  derived and/or modified sequence opt11 from capsid_protein_VP2__Norovirus__AGE89464
auggccggcgccuucuuugccggccuagcaucagacguucuaggcucaggccuaggaucacuaauaaacgcaggcgcuggcgccaucaaccaaaaaaucgacuucgaaaacaaccgcaaacuccagcaagcaagcuuccaauucagcuccaaccuccaacaagccucauuccaacacgacaaagaaaugcuacaagcacaaaucgaagcaaccaaaaaacuacaacaagaaaugaugaaagucaaacaagcaaugcuacucgaaggcggcuucucugaaaccgacgccgcccgcggcgcaauaaacgcccccaugacaaaaguccucgacuggucaggcacacguuacugggcccccgacgcacgaaccaccaccuacaacgccggccgcuucuccaccccccaacccuccggcacccugcccggccgcaucaacccccgcacccccacccccgcacgcggauccucaucaacccccuccaacgccuccaccgccaccuccauccacuccaaccaaaccguauccacccgccucggcucuaccgccggcuccggaacaaacguaagcucacuccccuccaccgcccgaacccgcagcugggucgaagaccaaaaccgcaaccucuccccauucaugcgcggagcacacaacaucuccuucgucacccccccauccucccgcucauccucacaaggcaccgucuccacaguccccaaagaaguccucgacucauggaccggcgcauucaacacccgccgccaaccccucuucgcccacauacgccgccgaggcgaaucccgcgucuaa

SEQ ID NO: 39549 - RNA, 807 nt, Artificial Sequence
  derived and/or modified sequence opt11 from capsid_protein_VP2__Norovirus__AGE89467
auggcaggcgccuucuucgccggacucgcauccgacguccuaggaucaggccuaggcucacucauaaacgcaggcgccggcgcaaucaaccaaaaaaucgacuucgaaaacaaccgcaaacuccaacaagcaagcuuccaauucagcagcaaccuccaacaagccuccuuccaacacgauaaagaaaugcuccaagcgcaaaucgaagccaccaaaaaauuacaacaagaaaugaugaaagucaaacaagcaaugcuccucgagggcggcuucucagaaacagacgcagcccgaggcgcaaucaacgcaccgaugacaaaaguccuagacuggucaggcacccgauacugggcaccagacgccagaaccacaacauacaacgcgggccgcuucucaaccccacaaccaucaggaacccugcccggacgcaucaacccccgaacccccacacccgcacgcggauccucaagcacaagcuccaacgcaagcaccgccaccagcauacacucaaaccaaaccgugagcacacgccucggauccaccgcaggcucaggcacaaacguaagcucacuccccuccacagcacgaaccagaagcugggucgaagaccaaaaccgcaaccuaagccccuucaugcgcggcgcccacaacauaagcuucguaacaccccccagcucccgcucaagcucucaaggcaccgucagcaccguccccaaagaaguccuagacucauggacaggcgcauucaacacacgacgccagccccuauucgcacacauacgccgacgaggcgaaucccgcguauaa

SEQ ID NO: 39550 - RNA, 807 nt, Artificial Sequence
  derived and/or modified sequence opt11 from capsid_protein_VP2__Norovirus__AGE89470
auggccggcgccuucuucgccggccuagccucagacguccucggcuccggacucggcucccucaucaacgccggcgccggagcaaucaaccaaaaaaucgacuucgaaaacaacagaaaacuccaacaagccuccuuccaauucuccuccaaccuccaacaagcaucauuccaacacgacaaagaaaugcuacaagcacaaaucgaagcaaccaaaaaacuacaacaagaaaugaugaaagucaaacaagcaaugcuacucgagggcggcuucuccgaaaccgacgccgcacgcggcgcaaucaacgccccaaugaccaaaguccucgacugguccggcacccgcuacugggcacccgacgcccgcgccaccaccuacaacgccggcagauucuccaccccccaacccucaggcacacuccccggccgcaucaauccccgcacccccacccccgcccgcggaucacccuccaccagcuccaacgccuccaccgccaccuccaucuacuccaaccaaaccgucuccacacgccuaggcucaaccgcgggcuccggaacaaacgucagcucacuccccuccaccgcccgcacccgcagcugggucgaagaccaaaacagaaaccucucccccuucaugcgcggcgcacacaacauaagcuucgucaccccccccuccucccgcuccagcucccaaggcacaguauccaccguccccaaagaaguccucgacuccuggaccggcgccuucaacacccgccgccaaccccucuucgcccacauccgccgacgaggcgaaucccgcgucuaa

SEQ ID NO: 39551 - RNA, 807 nt, Artificial Sequence
  derived and/or modified sequence opt11 from capsid_protein_VP2__Norovirus__AGE89473
auggcaggcgccuucuucgccggccucgccuccgacguccucggcuccggccucggcucccuaaucaacgccggcgcaggcgcaauaaaccaaaaaauagacuucgaaaacaaccgcaaacuccaacaagccagcuuccaauucuccucaaaccuacaacaagccuccuuccaacacgacaaagaaaugcuccaagcccaaaucgaagccaccaaaaaacuccaacaagaaaugaugaaagucaaacaagccaugcuccucgaaggcggcuucuccgaaaccgacgcagcccgcggcgccaucaacgcccccaugaccaaaguacucgacugguccggcacccgauacugggcacccgacgcccgcaccaccaccuacaacgccggccgauucuccaccccacaacccucaggcgcacucccaggccgcauaaacccccgcacacccacccccgcccgcggauccuccuccaccuccucaaacgccuccaucgccaccuccauccauucaaaccaaaccgucuccacccgccuaggcucaaccgcaggaucaggcaccaacgucuccucucuccccuccaccgcccgaacccgaucaugggucgaagaccagaacagaaaccuuuccccauucaugcgcggcgcacacaacaucagcuucgucaccccccccuccucccgcucaucaucccaaggcaccgucucaacggucccaaaagaaguccucgacuccuggaccggcgccuucaacacccgccgacaaccccucuucgcccacauccgccgccgcggcgaaucacgcgucuaa

SEQ ID NO: 39552 - RNA, 807 nt, Artificial Sequence
  derived and/or modified sequence opt11 from capsid_protein_VP2__Norovirus__AGE89476
auggccggcgccuucuucgccggacucgccagcgacguccucggaucaggccuaggcucccucaucaacgccggcgccggcgccaucaaccaaaaaaucgacuucgaaaacaaccgcaaacuccaacaagccuccuuccaauucucauccaaccuccaacaagccuccuuccaacacgacaaagagaugcuccaagcccaaaucgaagcaaccaaaaaacuucaacaagaaaugaugaaagucaagcaagccaugcuccucgaaggcggcuucuccgaaaccgacgccgcccgcggcgccaucaacgccccaaugaccaaaguccuagacuggucaggaacccgcuacugggcccccgacgcccgcaccaccaccuacaacgccggcagauucucaaccccacaacccagcggcacccuccccggacgcauaaacccacgcacccccacacccgcccgcggaagcucauccaccucauucaacgccuccaccgccaccagcauacacucaaaccaaaccguaucaacacgccucggauccacagccggcuccggaacaaacgucagcucgcuccccagcacagcccgcacccgcuccugggucgaagaccaaaacagaaaccucuccccauucaugcgcggcgcccacaacaucagcuucgucacccccccaagcucccgcuccuccucacaaggaaccguauccaccgucccaaaagaaguccucgacucuuggacaggcgccuucaacacccgccgccaaccccucuucgcacacauccgccgacgcggcgaaucccgcgucuaa

SEQ ID NO: 39553 - RNA, 807 nt, Artificial Sequence
  derived and/or modified sequence opt11 from capsid_protein_VP2__Norovirus__AGE89479
auggccggcgcauucuucgccggccucgccagcgacguccuaggcucaggccuaggcucccucaucaacgccggcgcaggcgcaaucaaccaaaaaaucgacuucgaaaacaaccgaaaacuccaacaagccuccuuccaauucagcuccaaccuccaacaagccucguuccaacacgacaaagaaaugcuacaagcgcaaauagaagccaccaaaaaacuacaacaagaaaugaugaaagucaaacaagccaugcugcucgaaggcggcuucuccgaaacagacgccgcacgcggcgcaaucaacgccccaaugaccaaaguacuagacugguccggaacccgcuacugggcccccgacgcccggaccacaaccuacaacgccggccgcuucucaacaccccaauccagcggcacccuacccggccgcauaaacccccgcacccccaccccagcccgcggcagcucauccaccuccuccaacgccuccacagccacauccauccacuccaaccaaacaguaagcacacgccuuggcucgaccgccggauccggcaccaacguauccucacaccccagcacggcccgcacccguuccugggucgaagaccaaaaccgcaaccucuccccauucaugcgcggagcccacaacaucuccuucgucaccccccccuccucgcgcuccuccucccaaggaacagucuccacagucccaaaagaaguccucgacuccuggacuggcgcauucaacacccgucgccaaccacuauucgcccacauccgccgacgcggcgaaucccgcguguaa

SEQ ID NO: 39554 - RNA, 807 nt, Artificial Sequence
  derived and/or modified sequence opt11 from capsid_protein_VP2__Norovirus__AGE89482
auggcuggcgcauucuucgccggccuagccuccgacguccucggcuccggccucggcucacucauaaacgcaggcgcaggcgccaucaaccaaaaaauugacuucgaaaacaaccgaaaacuccaacaagccagcuuccaauucuccucaaaccuacaacaagccuccuuccaacacgacaaagaaaugcuccaagcccaaauagaagcaaccaaaaaacuacaacaagaaaugaugaaagucaaacaagcaaugcuacucgaaggcggauucucagaaacagacgccgcccgcggagccaucaacgccccgaugaccaaaguccucgacuggucaggcacccgcuacugggcccccgacgcacgaaccaccaccuacaacgccggacgcuucucgaccccacaaccgagcggcacccuccccggccgcauaaacccaagaacacccacacccgcacgcggcuccucaagcacaagcuccaacgccucaacggccacauccaucuacucaaaccaaaccguaagcacccgccucggcucaaccgccggcuccggcacaaacgucagcucccuccccagcacagcccgaaccagaagcugggucgaagaccaaaaccgaaaccucagccccuucaugcgcggagcccacaacaucagcuucguaacaccccccagcucacgcucaagcucacaaggcaccguaucuacaguccccaaagaaguccuagacuccuggacgggcgcauucaacacccgacgccaaccccucuucgcccacauccgaaggcgcggagaaucacgcguauaa

SEQ ID NO: 39555 - RNA, 807 nt, Artificial Sequence
  derived and/or modified sequence opt11 from capsid_protein_VP2__Norovirus__AGE89485
auggcgggcgcauucuucgccgggcuagccuccgacguccuaggcucaggccuaggcucgcucauaaacgcaggcgcaggcgcaauaaaccagaaaaucgacuucgagaacaaccgcaaacuucaacaagcgagcuuccaauucagcucaaaccuacaacaagccucauuccagcacgacaaagagaugcugcaagcacaaauagaagcaaccaagaaacugcaacaggaaaugaugaagguaaagcaagcaaugcugcucgaaggcggauucucagaaacggacgcagcccggggcgcgaucaacgccccgaugacgaaagugcucgacuggucgggaacacgauacugggcgcccgacgcccgaaccacgaccuacaacgcaggcagguucucgaccccgcaaccaagcggaacccuacccggacgcauaaacccccgaacccccacgcccgcgcgcggaagcucgagcacaagcucgaacgcaagcacagccacgagcauacacucaaaccaaaccguaagcacacgccuaggcucaaccgcgggcucaggcacgaacgugagcucgcucccgagcacggcccgaaccagaagcuggguagaagaccagaacaggaaccuaagcccauucaugcgcggagccaggaacaucagcuucgucacgcccccgagcucacgcucaagcucccaaggaaccguaagcaccgucccgaaagaaguccuggacucauggacaggugcauucaacaccagacgccagccccuguucgcacacauacgcaggcgcggggaaucgcgcguauaa

SEQ ID NO: 39556 - RNA, 807 nt, Artificial Sequence
  derived and/or modified sequence opt11 from capsid_protein_VP2__Norovirus__AGE89488
auggcaggagcguucuucgccgggcucgcgagcgacgucuugggcucgggccuaggcucgcucauaaacgcgggcgcgggcgccauaaaccaaaagaucgacuucgagaacaaccgcaaacuucagcaagcgagcuuccaauucagcucgaaccugcaacaggccucauuccagcacgauaaggagaugcugcaagcacaaaucgaagcgaccaagaaacugcaacaggaaaugaugaaagucaagcaagcgaugcugcuagagggcggguucucggaaacggacgcggccagaggcgcgaucaacgccccgaugacaaaagugcucgauuggucgggcacgcgauacugggcgcccgaugccaggaccacgaccuacaacgcgggcagauucucggccccacaaccaagcgggagcuugccaggacgaauaaacccgcgcgcgcccacgcccgcgcgagugagcucgagcacgagcucaaacgcgagcacagucacgagcauauacucgaaccagaccguaagcacgcgccuaggcucgaccgcaggcucaggcacgaacgugagcucacucccaagcacggcaaggaccaggagcugggucgaggaccagaacaggaaccugagcccauucaugcgcggggcccacaacaucagcuucguaacacccccgagcucgcgaucgagcucgcaagggaccgugagcacagucccgaaagaggucuuggacucauggacaggcgcauucaauaccagacgccagccccuauucgcgcacauacgcagacgcggagaaucgagaguguga

SEQ ID NO: 39557 - RNA, 807 nt, Artificial Sequence
  derived and/or modified sequence opt11 from capsid_protein_VP2__Norovirus__AGE89491
auggcaggcgccuucuucgcaggccucgccagcgacguccucggaucaggccucggcucccucauaaacgccggcgcaggcgcaauaaaccaaaaaaucgacuucgaaaacaaccgcaaacuccaacaagcauccuuccaauucuccucuaaccuccaacaagcuucauuccaacacgacaaagaaaugcuccaagcccaaaucgaagccaccaaaaaacuccaacaagaaaugaugaaagucaaacaagccaugcuacucgaaggcggcuucuccgaaaccgacgcagcccgaggcgcaauaaacgcccccaugaccaaaguacucgacuggucaggcacccgcuacugggcccccgacgcccgcaccacaaccuacaacgccggccgcuucucaaccccccaaccaagcgguacccucccaggccgcaucaacccacgcacacccacccccgcccgcggcagcuccuccaccuccucuaacgccuccacagccaccuccauccacuccaaccaaaccguaagcacccgccucggcuccaccgccggcucaggcaccaacguauccucacucccauccacagcccgcacccgcuccugggucgaagaccaaaaccgcaaccucucccccuucaugcgcggcgcccacaacauauccuucgucaccccccccuccucacgauccuccucacaaggcaccguaagcaccguccccaaagaaguacuagacucauggaccggcgccuucaauacccgccgccaaccccucuucgcacacauccgccgccgcggcgaaucacgaguauaa

SEQ ID NO: 39558 - RNA, 807 nt, Artificial Sequence
  derived and/or modified sequence opt11 from capsid_protein_VP2__Norovirus__AGE89494
auggcgggcgccuucuucgccggacucgcauccgacguccucggcuccggccuuggaucacucaucaacgccggcgccggcgcaaucaaccaaaaaaucgacuucgaaaacaaccgaaaacuccaacaagccuccuuccaauucagcucaaaccuccaacaagccuccuuccaacacgacaaagaaaugcuccaagcccaaaucgaagccaccaaaaaacuacaacaagaaaugaugaaagucaaacaagcaaugcuccuagaaggcggauucuccgaaacagacgcagcccgcggagcaaucaacgcccccaugacaaaaguccucgacugguccggcaccagauacugggcacccgacgccagaaccaucaccuacaacgcaggcagauucuccaccccccaaccaagcggcacccuacccggccgcaucaacccacgcgcacccacacccgcccgcggauccucaagcaccuccuccaacgccuccaccgccaccagcaucuacuccaaccaaacagucagcacccgacucggcuccaccgccggcuccggcacaaacgucuccucacucccauccaccgccaggacccgauccugggucgaagaccaaaaccgcaaccuaucccccuucaugcgcggcgcccacaacaucagcuucgucaccccaccguccucccgcuccagcucccaaggcaccgucuccaccguccccaaagaaguccucgacucauggaccggcgccuucaacaccagacgacaaccccuauucgcgcacauacgccgccgcggagaaucccgcguauga

SEQ ID NO: 39559 - RNA, 807 nt, Artificial Sequence
  derived and/or modified sequence opt11 from capsid_protein_VP2__Norovirus__AGE89497
auggccggcgccuucuucgccggccucgcuuccgacguccuaggcucaggccucggcucacucaucuccgccggagccggcgccaucaaccaaaaaaucgacuucgaaaacaaccgcaaacuccaacaagcauccuuccaauucagcuccaaccuacaacaagcaucguuccaacacgacaaagaaaugcuccaagcccaaauagaagccaccaaaaaacuccaacaagaaaugaugaaagucaaacaagccaugcuccucgaaggcggcuucucagaaaccgacgcagcccgcggcgccaucaacgcccccaugaccaaaguccucgacuggucaggcacccgcuacugggcccccgacgccagaaccaccacauacaacgccggccguuucucaaccccccaacccuccggcacccuacccggccgaauaaacccccgcacccccacccccgcacgaggcuccuccagcaccagcucaaacgccuccaccgccaccuccaucuacuccaaccaaaccgucagcacacgccuuggcuccaccgcaggcuccggcacaaacgucucaucccuacccagcaccgcccgcacccgauccugggucgaagaccaaaaccgcaaccucuccccauucaugcgcggcgcccacaacauauccuuuguaacaccccccucaucacgcuccuccucccaaggcacaguaucaaccguccccaaagaaguccuagacucauggaccggcgccuucaacaccagacgccaaccccucuucgcccacauccgccgccgaggcgaaucacgaguauaa

SEQ ID NO: 39560 - RNA, 807 nt, Artificial Sequence
  derived and/or modified sequence opt11 from capsid_protein_VP2__Norovirus__AGE89500
auggccggcgccuucuucgccggccucgccuccgacguccuaggauccggccucggcucccucauaaacgccggcgccggcgccaucaaccagaaaaucgacuucgaaaacaaccgcaaacuccaacaagccuccuuccaauucagcuccaaccuccaacaagccucauuccaacacgacaaagaaaugcuacaagcccaaauagaagcaaccaagaaacuccaacaagaaaugaugaaagucaaacaagccaugcuccucgaaggcggauucuccgaaacugacgccgcccgcggcgccaucaacgcccccaugacaaaaguccuagacuggucaggcacccgcuacugggcccccgacgcacgcacaaccaccuacaacgcaggccgcuucuccaccccacaacccuccggcacccuccccggccgaaucaacccccgcacccccacaccagcccgcggcagcuccuccaccuccucaaacgcauccaccgcaaccuccauccacuccaaccaaaccgucuccacccgccucggcuccacagccggcuccggaaccaacgucucaucucuccccagcaccgcccgaacccguuccugggucgaagaccaaaacagaaaccucaguccauucaugcgaggggcccacaacaucagcuucgucaccccaccuuccucccgcuccuccucacaaggaaccgucuccaccgucccaaaagaaguacuagacucauggaccggcgccuucaacacccgccgccaaccccuauucgcccacauccgccgccgcggagaaucccgaguauaa

SEQ ID NO: 39561 - RNA, 807 nt, Artificial Sequence
  derived and/or modified sequence opt11 from capsid_protein_VP2__Norovirus__AGE89503
auggccggcgccuucuucgccggccuagccuccgacguccuaggcuccggccucggaucccucaucaacgcaggcgcaggagcaauaaaccaaaaaaucgacuucgaaaacaaccguaaacuccaacaagcauccuuccaauucagcucaaaccuccaacaagccuccuuccaacacgacaaagaaaugcuacaagcacaaaucgaagccaccaaaaaacuccaacaagaaaugaugaaaguaaaacaagccaugcuccucgagggcggcuucuccgaaaccgacgccgccagaggagccauaaacgcccccaugacaaaagugcucgacugguccgguacccgcuacugggccccagacgcccgaaccaccaccuacaacgccggacgcuucuccaccccccaacccuccggcacccuacccggccgcaucaacccucgcacccccacacccgcccgcggcuccuccuccaccuccuccaacgccuccaccgcuaccuccauccacucuaaccaaaccgucuccacccgccucggcucuacagccggcuccggaacaaacgucuccucccucccauccaccgcccgaacccgcagcugggucgaagaccaaaaccgaaaccucucccccuucaugcgcggcgcccacaacauaucauucgucaccccccccuccucccgcuccuccucccaaggcacagucuccacuguccccaaagaaguacucgacuccuggacuggagcauucaacacccgacgccaaccucucuucgcccacauacgccgccgcggagaaucacgagucuaa

SEQ ID NO: 39562 - RNA, 807 nt, Artificial Sequence
  derived and/or modified sequence opt11 from capsid_protein_VP2__Norovirus__AGE89506
auggcaggagcauucuucgccgggcucgcaagcgacguccuaggaucaggacugggaucgcucauaaacgcaggagcaggcgcaaucaaccagaaaaucgacuucgagaauaaccgcaagcuacaacaagccagcuuccaauucuccucaaaccuacaacaagcaucauuccaacacgacaaagaaaugcugcaagcacaaauagaagcgaccaagaaacuccaacaagaaaugaugaaaguaaaacaagcgaugcugcuagaaggcggauucucagaaacagacgcggcccgaggagcaaucaacgccccaaugacaaaagugcucgacuggucaggcacgcgcuacugggcccccgacgccagaaccacgaccuacaacgcaggcagauucucgaccccacaaccaagcgggacccuacccggccgcauaaacccgcgaacacccacacccgcgcguggaagcucaagcacgagcucaaacgcaagcacagccaccagcaugcacuccaaccaaaccguauccacgcgacuaggaucaaccgcaggcucgggcacgaacguaagcucgcucccaagcacggccagaacccgauccugggucgaagaccaaaaccgaaaccuguccccauucaugcgcggagcccacaacauauccuucgucacgcccccaagcucacgcucgagcucacaaggaaccguaagcacggucccaaaagaaguccuagacucauggacaggagccuucaacacccgacgccaaccccuauucgcgcacauacgcagacgcggggaaucgcgcguauaa

SEQ ID NO: 39563 - RNA, 807 nt, Artificial Sequence
  derived and/or modified sequence opt11 from capsid_protein_VP2__Norovirus__AGE89509
auggccggcgcauucuuugcaggacucgcauccgacguccuaggcuccggccucggcucacuaauaaacgccggcgcaggcgcaauaaaccaaaaaaucgacuucgaaaacaaccgcaagcuccaacaagcgagcuuccaauucagcuccaaccugcaacaagccucguuccaacacgacaaagaaaugcuacaagcccaaauagaagcaaccaaaaaacugcaacaagaaaugaugaaagucaaacaagccaugcugcucgaaggcggauucucagaaacagacgccgccagaggcgcaaucaacgccccaaugacaaaagugcuagacuggucaggcacacgcuacugggcccccgacgccagaaccacaaccuacaacgcaggcagauucucaaccccccaaccaagcggcagccuacccggccgcauaaacccccgcgcacccacacccgcacgagcaagcucauccaucuccucaaacgcaagcaccguaaccuccauauacuccaaccaaaccgucagcacacgccuaggcucaacagccggcucaggcacaaacguaagcucacucccaagcacagccaggacccgaagcugggucgaagaccaaaaccgcaaccucucaccauucaugcgaggagcacacaacauaagcuucgucaccccaccauccucacgcucaagcucacaaggcaccguaagcaccgucccaaaagaaguccuagacucguggacaggcgcauucaacaccaggcgccaaccccuguucgcccacauacgcagacgcggcgaaucacgagucuga

SEQ ID NO: 39564 - RNA, 807 nt, Artificial Sequence
  derived and/or modified sequence opt11 from capsid_protein_VP2__Norovirus__AGE89512
auggccggagcauucuucgccggacucgccuccgacguccucggcuccggccuaggcucccucaucaacgccggcgccggcgccaucaaccaaaaaaucgacuucgaaaacaaccgcaaacuccaacaagccuccuuccaauucuccucaaaccuccaacaagcaucauuccaacacgacaaagaaaugcuacaagcacaaaucgaagccaccaaaaaacuccaacaagaaaugaugaaagucaaacaagccaugcuacucgaaggcggcuucucagaaacagacgccgcacgcggcgccaucaacgcccccaugacaaaaguccucgacugguccggcacccgcuacugggcccccgacgccagaacaacaaccuacaacgccggccgcuucuccaccccccaaccauccggcacccucccaggccgcauaaacccccgcacacccacacccgcacgcggaagcucaagcaccagcuccaacgcauccacagccacaucaauccacuccaaccaaaccgucuccacacgacuaggcucgaccgccggcuccggcaccaacgucucaucccuccccuccaccgcccgaacaagauccugggucgaagaccaaaaccgcaaccuaagccccuucaugcgaggcgcccacaacauauccuucguaacccccccguccucucgcucaagcucacaaggcaccgucuccacagucccaaaagaaguccuagacucguggacaggcgcauuuaacacccgacgccaaccccucuucgcccacauacgccgacgcggcgaaucccgcguauaa

SEQ ID NO: 39565 - RNA, 807 nt, Artificial Sequence
  derived and/or modified sequence opt11 from capsid_protein_VP2__Norovirus__AGE89515
auggccggcgcauucuucgccgggcucgccuccgacguccucggcuccggcuuaggcucacucaucaacgccggcgcaggagcaaucaaccaaaaaaucgacuucgaaaacaaccgcaaacuccaacaagccagcuuccaauucagcuccaaccugcaacaagccucauuccaacacgacaaagaaaugcuacaagcucaaauagaagcaaccaaaaaacuacaacaagaaaugaugaaagucaaacaagcaaugcuccucgaaggaggcuucucggaaaccgacgcagcccgcggcgcaaucaacgcacccaugaccaaaguguuagacugguccggaacacgcuacugggcccccgacgccagaaccacaaccuacaacgcaggccgauucucaaccccccaacccagcggaacccuacccggacgcaucaacccccgcaccccaacacccgcccgcggcagcuccucaacaagcuccaacgccagcacagccacauccaucuacuccaaccaaaccgucuccacacgacucggcucaaccgccggcucgggcacaaacguaagcucacuaccgagcacagcaagaacccgcuccugggucgaagaccaaaacagaaaccucuccccauucaugcgcggagcccacaacauaagcuucgucacccccccaagcucccgauccuccucacaaggaacaguaagcacagucccaaaagaaguccucgacucauggaccggcgccuucaacacccgacgccaaccccucuucgcccacauccgccggcgcggagaaucacgcgucuaa

SEQ ID NO: 39566 - RNA, 807 nt, Artificial Sequence
  derived and/or modified sequence opt11 from capsid_protein_VP2__Norovirus__AGE89518
auggccggcgccuucuucgccggccucgccuccgacguccucggcuccggccucggcucccucaucaacgccggcgccggcgccaucaaccaaaaaaucgacuucgaaaacaaccgcaaacuacaacaagccucuuuccaauucuccucaaaccuacaacaagccucauuccaacacgacaaagaaaugcuccaagcccaaaucgaagccaccaaaaaacuccaacaagaaaugaugaaagucaaacaaacaaugcuacuagagggcggcuucuccgaaaccgacgccgcccgcggcgccaucaacgcccccaugaccaaaguccucgacugguccggcacacgcuacugggcccccgacgccagaaccaccaccuacaacgccggccgauucuccaccccccaacccucaggcacccuccccggccgcaucaacccacgaacacccacccccgcccgcggcuccucauccacauccucuaacgcaagcaccgcaaccucaauacacuccaaccaaaccgucucaacccgucuaggcuccacagccggcuccggcacaaacgucuccucccucccaucaaccgcccgcacccgcuccugggucgaagaccaaaaccgcaaccuaucaccauucaugcgcggcgcccacaacaucuccuucgucaccccaccauccucccgcuccuccucccaaggcaccguauccacugucccaaaagaaguccucgacuccuggaccggcgccuucaacacccggcgccaaccacucuucgcccacauacgccgccgcggagaaucccgcguauaa

SEQ ID NO: 39567 - RNA, 807 nt, Artificial Sequence
  derived and/or modified sequence opt11 from capsid_protein_VP2__Norovirus__AGE89521
auggcgggcgcauucuucgccgggcuagcaagcgacguccuaggaucaggccuaggcucacucauaaacgcgggcgcaggcgcaauaaaccagaaaaucgacuucgaaaacaaccgcaaacuccaacaaguauccuuccaauucuccucaaaccugcaacaagccucguuccaacacgacaaagaaaugcuacaagcgcaaauagaagcaaccaagaaacuacaacaagaaaugaugaaagucaaacaagcaaugcugcucgaaggcggguucuccgaaacagacgcagccaggggcgcaaucaacgcccccaugacaaaaguacucgacuggucgggcacacgcuacugggcgcccgacgcccgaaccacaaccuacaacgcgggcagguucucaaccccacaaccaagcgggacacuacccggacgcauaaacccacgaacccccaccccagcacgcggaagcucgagcacauccucaaacgcgagcacagccacgagcauacacucaaaccagaccgugagcacgcgccucggaucgaccgcgggcucgggcacaaacguaagcucacucccauccacggccaggaccagguccugggucgaggaccaaaacagaaaccugagcccauucaugcgcggcgcccacaacaucagcuucgucacgcccccguccucacgcucaagcucacaaggaaccgucuccacagucccaaaagaaguccucgacucguggacaggcgcauucaacaccagacgccaaccccucuucgcacacauacgcagacgcggggaaucacgcguauaa

SEQ ID NO: 39568 - RNA, 807 nt, Artificial Sequence
  derived and/or modified sequence opt11 from capsid_protein_VP2__Norovirus__AGE89524
auggcaggcgcguucuucgccggacucgcaagcgacguccuaggcucgggccugggaucgcucauaaacgcgggcgcaggcgcaauaaaccagaaaauagacuucgaaaacaaccgcaaacuccaacaagccagcuuccaauucagcucgaaccuacaacaagcauccuuccaacacgacaaagagaugcuacaagcacaaauagaagcgaccaagaaacugcaacaggaaaugaugaaaguaaaacaagcaaugcuacucgagggcggauucucagaaacagacgcagccaggggcgcaaucaacgccccgaugaccaaaguacucgacuggucgggcacacgcuacugggcgcccgacgcccggaccacaaccuacaacgcaggccgauucucaaccccacaaccgagcggaacccuacccgggcgcauaaacccccgcacacccacgccagcacgaggguccucguccacaagcuccaacgcgagcacagccacgagcauacacucaaaccaaacaguauccacgcgccuaggcucgacagcgggaucaggcacaaacgugagcucacucccgagcacagccagaaccaggagcugggucgaagaccagaaccgaaaccugagcccauucaugcgcggggcccacaacaucagcuucgucacacccccaagcucacgcucauccucacaaggaaccgugagcacagucccaaaagagguccuggacucauggacgggcgcauucaacaccaggcgccagccccuauucgcgcacauacgcaggcgcggggaaucccgcguguaa

SEQ ID NO: 39569 - RNA, 807 nt, Artificial Sequence
  derived and/or modified sequence opt11 from capsid_protein_VP2__Norovirus__AGE89530
auggcaggcgcauucuucgccggccucgccuccgacguccuaggcuccggccucggcucccucaucaacgccggagcaggcgccaucaaccaaaaaaucgacuucgaaaacaaccgaaaacuccaacaagcauccuuccaauucagcuccaaccuccaacaagcaucuuuccaacacgauaaagaaaugcuccaagcccaaaucgaagcaacaaaaaaacuccaacaagaaaugaugaaagucaaacaagccaugcuacuagaaggaggcuucuccgaaaccgacgccgccagaggcgcaaucaacgcacccaugaccaaaguacucgacuggucaggcacacgcuacugggcccccgacgcccgcaccaccaccuacaacgccggccgcuucuccaccccccaacccuccggaacccuacccggccgcaccaacccccgcaccccaaccccagcccgcggauccuccuccaccuccuccaacgcauccaccgccacaucaauauacuccaaccaaaccguauccacacgacuaggaucaaccgcaggcucgggcaccaacgucagcucacucccauccaccgccagaacacgcuccugggucgaagaccaaaacagaaaccucucccccuucaugcgcggggcccacaacauauccuucgucacaccaccauccucccgcuccuccucacaaggcaccgucucaaccguccccaaagaaguacucgacuccuggaccggcgccuucaacaccagacgccaaccccuauucgcacacauacgccgccgcggcgaaucccgcgucuga

SEQ ID NO: 39570 - RNA, 807 nt, Artificial Sequence
  derived and/or modified sequence opt11 from capsid_protein_VP2__Norovirus__AGE89533
auggccggcgcauucuucgccggacucgccuccgacguccuaggauccggccucggcucacuaaucaacgccggcgccggcgccaucaaccaaaaaaucgacuucgaaaacaaccgcaaacuacaacaagcauccuuccaauucagcuccaaccuacaacaagccuccuuccaacacgacaaagaaaugcuacaagcccaaaucgaagccaccaaaaaacuccaacaagaaauaaugaaaguaaaacaagcaaugcuccucgaaggcggcuucagcgaaacagacgccgcaagaggcgcaaucaacgccccaaugaccaaaguacucgacuggucaggaacccguuacugggcacccgacgcccgaaccacaaccuacuccgcaggccgcuucucaaccccccaacccuccggcacccuccccggccgcauaaacccccgaacccccacccccgcccgcggauccucguccaccuucucaaacgccuccaccgccacaagcauccacucaaaccaaaccgucucaacacgccucggcuccaccgccggcuccggcacaaacgucuccucacucccaucaaccgcccgcaccagguccugggucgaagaccaaaaccgcaaccucagcccuuucaugcgcggcgcccacaacaucuccuucgucacccccccgucaucccgcucaucaucacaaggaaccgucuccaccgucccaaaagaaguccuagacucauggaccggagcauucaacacccgccgccaaccccucuucgcccacauccgccgccgcggagaaucccgcgucuaa

SEQ ID NO: 39571 - RNA, 807 nt, Artificial Sequence
  derived and/or modified sequence opt11 from capsid_protein_VP2__Norovirus__AGE89536
auggcaggagcauucuucgccggccucgcguccgacguccuaggcucaggacucggcucccucauaaacgccggcgcaggcgccaucaaccaaaaaaucgauuucgaaaacaaucgaaaacuccaacaagcauccuuccaauucagcucaaaccuacaacaagccuccuuccaacacgacaaagaaaugcugcaagcacaaaucgaagcaaccaaaaaacuacaacaagaaaugaugaaagucaaacaagcaaugcuccucgaaggcggauucucagaaacagacgcagcccgcggcgcaaucaacgccccaaugaccaaaguacuagacugguccggaacacgcuacugggcacccgacgccagaaccaccacauauaacgcaggcagauucuccaccccacaaccaagcggcacccugcccggacgaaucaacccacgaacaccaacaccagcacgcggguccuccagcaccagcuccaacgccagcacagccaccagcaucuacuccaaccaaaccguuagcacacgucucggcucaaccgcaggcuccggcaccaacgucagcucgcuccccagcacagcaagaacccgaagcugggucgaagaccaaaacagaaaccuaagcccauucaugcgcggagcccacaacauaagcuucguaacacccccaagcucacgcucgagcucgcaaggcaccguaagcacagucccaaaagagguacuagacucauggacaggcgccuucaacacccgacgccaaccccuauucgcccacauccgcagacgcggagaaucacgcguauga

SEQ ID NO: 39572 - RNA, 807 nt, Artificial Sequence
  derived and/or modified sequence opt11 from capsid_protein_VP2__Norovirus__AGE89539
auggcgggcgccuucuucgcaggacucgcgagcgacguccugggcucgggacuaggcucgcucauaaacgcgggcgcgggcgcaaucaaccagaaaauagacuucgaaaacaaccgcaagcuccaacaagccagcuuccaauucagcucaaaccugcaacaagcaucauuccagcacgauaaagagaugcugcaagcgcaaauagaagcgaccaagaaacuacaacaggaaaugaugaaggucaaacaagcaaugcugcucgagggcggguucucggaaacggacgcggccaggggcgcgaucaacgccccgaugacgaaagugcucgacuggucgggcacacgcuacugggcgcccgacgccaggacaacgacauacaacgcaggaagauucucaaccccgcaaccgagcgggacccugcccgggcgcauaaacccgcgcacgcccacgcccgcacguggguccucaagcacgagcucaaacgcgagcacggccacgagcauauacucgaaccaaaccguguccacgcgccuaggcucgaccgcaggcucaggcacgaacgugagcucacucccaagcacagccagaaccagaagcugggucgaggaccagaacagaaaccuaagcccguucaugcgaggcgcccauaacauuagcuucgucacgcccccaagcucacgaucguccucacaaggaaccgugagcacggucccaaaagaaguccuagacucguggacgggcgcguucaacacaaggcgccaaccccucuucgcacacauacgcaggcgcggggaaucacgcguguga

SEQ ID NO: 39573 - RNA, 807 nt, Artificial Sequence
  derived and/or modified sequence opt11 from capsid_protein_VP2__Norovirus__AGE89542
auggcaggcgcauucuucgccgggcucgcauccgacguccugggaucgggccugggcucccucauaaacgcgggcgcaggcgcgauaaaccaaaagaucgacuucgagaacaaccgcaagcuacagcaagcgagcuuccaauuuagcucgaaccugcaacaagccucguuccagcacgacaaagaaauguugcaagcacaaauagaagcgaccaagaaacugcaacaagaaaugaugaaggucaaacaagcgaugcugcucgagggcggguucucagaaacagacgcggccaggggcgcgaucaacgcaccaaugacgaaaguacucgacuggucgggcacgcgcuacugggcacccgacgccaggaccacaaccuacaacgcaggcagguucucgaccccacaaccgagcggaacccuacccgggcgaauaaacccgcgcacgcccacgcccgcgagagggagcucgagcacgagcucgaacgcguccacggccacaagcauauacucgaaccagaccgugagcacgcgacuaggaucgaccgccggcuccggcacgaacgugagcucccucccaagcacggccaggacaagaagcugggucgaggaccaaaacagaaaccuaagcccauucaugcgcggggcccacaacauaucauucguaacgcccccaagcucccgcucgagcucacaaggcaccgugagcacgguccccaaagagguacuggacucguggacaggagcauucaauaccaggcgccagccccuguucgcgcacauacgcagacgaggggaaucgagaguguga

SEQ ID NO: 39574 - RNA, 807 nt, Artificial Sequence
  derived and/or modified sequence opt11 from capsid_protein_VP2__Norovirus__AGE89545
auggccggcgcauucuucgccggacucgcauccgacguccucggcucaggccugggcucccuaaucaacgccggcgccggcgccaucaaccaaaaaaucgacuucgaaaacaaccgcaaacuccaacaagccagcuuccaauucuccucgaaccuccaacaagccuccuuccaacacgacaaagaaaugcuccaagcccaaaucgaagccaccaagaaacuccaacaagaaaugaugaaagucaaacaagccaugcugcucgaaggcggauucuccgaaaccgacgcagccagaggcgccaucaacgcacccaugacaaaaguccucgacugguccggcacacgcuacugggcacccgacgccagaaccacaaccuacaacgccggccgcuucuccaccccccaaccauccggcacccuccccggccgcauaaauccccgcacccccacaccagcccgcggcuccucauccaccagcuccaacgcauccacagccaccagcaucuacuccaaccaaaccgucuccacacgccuaggcuccaccgcaggcuccggcaccaacguguccucacuacccuccaccgccagaacccgcuccuggguagaagaccaaaacagaaaccucucaccauucaugcgcggcgcccacaacaucuccuucgucacccccccuuccucccgauccagcucccaaggaaccguaagcaccguccccaaagaaguccuagacuccuggacaggagcauucaacaccagacgacaaccccuauucgcccacauacgcagacgcggagaaucacgcgucuaa

SEQ ID NO: 39575 - RNA, 807 nt, Artificial Sequence
  derived and/or modified sequence opt11 from capsid_protein_VP2__Norovirus__AGE89548
auggcgggcgcauucuucgccggacucgcauccgacguccucggcucgggccugggcucacucauaaacgcgggcgcaggcgcaauaaaucagaaaaucgacuucgaaaacaaccgcaaacuucaacaagccagcuuccaauucagcucaaaccuacaacaagcaucauuccaacacgacaaagagaugcuacaagcacaaauagaagcaaccaagaaacuacaacaggaaaugaugaaaguaaaacaagccaugcuacucgaaggcggcuucucagaaacagacgcagccagaggagcgaucaacgccccaaugacaaaaguacuagacuggucaggcacgcgcuacugggcacccgacgccaggaucacgaccuacaacgcgggcagauucucgaccccgcaaccgagugggacccuaccaggacgcauaaacccacgcacgcccacacccgcgcgcggaagcucaagcacaagcucaaacgcgagcacagccacaagcauccacucgaaccagaccguaucaacgcgccuaggcuccacagcgggcuccggcacaaacgugagcucgcucccaagcacagccaggaccagaagcugggucgaagaccaaaacagaaaccuaagcccauucaugcgcggggcccacaacaucagcuucgucacaccacccagcucacgcucaagcucacaaggaacagugaguacgguccccaaagaaguccuggacuccuggacgggugcauucaacaccagacgccaaccccucuucgcgcacauacgcaggcgaggagaaucgcgcguguaa

SEQ ID NO: 39576 - RNA, 807 nt, Artificial Sequence
  derived and/or modified sequence opt11 from capsid_protein_VP2__Norovirus__AGE89551
auggccggcgcauucuucgccggacucgcgagcgacguccuaggcucuggccugggcucacucauaaacgccggcgcaggcgccauaaaccagaaaaucgacuucgaaaacaaccgcaaacuccaacaagccagcuuccaauucagcuccaaccuccaacaagcaucauuccaacacgacaaagaaaugcuccaagcacaaauagaagcaacaaagaaacuccaacaagaaaugaugaaagucaaacaagcaaugcuacucgagggcggauucucggaaacagacgcagcccgaggcgccaucaacgcccccaugaccaaaguacuagacuggucgggcacacgcuacugggcaccugacgccagaaccacgaccuauaacgcaggcagauucucgacaccccaaccaucaggaacccuacccggccgcauaaacccacgcacccccacacccgcccgcggaaguucaagcacaagcuccaacgccagcacagccaccuccauacacucaaaccaaaccguauccacacgccuaggcucaaccgccggcuccggcacaaacguaagcucccucccaagcaccgccagaaccagaagcugggucgaagaccaaaaccgcaaccuaucaccguucaugcgcggcgcacacaacaucagcuucgucacacccccaagcucacgcucgagcucacaaggcaccguaagcacagucccaaaagaaguccucgacucauggacaggcgccuucaacaccagacgccaaccccuauucgcgcacauacguagacgcggcgaaucacgcguauaa

SEQ ID NO: 39577 - RNA, 807 nt, Artificial Sequence
  derived and/or modified sequence opt11 from capsid_protein_VP2__Norovirus__AGE89554
auggccggcgccuucuucgccgggcuagcaagcgacguccuaggcucaggccugggcucccuaauaaacgccggcgcaggcgcaaucaaccaaaaaaucgacuucgaaaacaaccgcaaacuccaacaagccuccuuccaauucagcucgaaccuccaacaagccuccuuccaacacgacaaagaaaugcuccaagcccaaaucgaagcaaccaaaaaacuccaacaagaaaugaugaaagucaaacaagccaugcuccucgaaggcggauucucagaaaccgacgcagcccgaggcgcaaucaacgccccaaugaccaaaguccuugacuggucgggcacccgcuacugggccccagacgcccgcaccacaaccuacaacgcuggacgcuucucagccccacaacccuccggcagccuacccggccgcauaaacccacgcgcacccacgcccgcacgaguaagcucaagcacaagcucaaacgccagcacagucacauccauauacucaaaccagaccgucagcacacgccucggcuccaccgcaggcuccggcaccaacgucagcucccuccccuccacagccagaaccagauccuggguagaggaccaaaaccgcaaccucuccccauucaugcgcggagcccacaacauuagcuucgucaccccacccuccucccgcuccuccucacaaggcaccgucucaacaguccccaaagaaguacuagacuccuggacaggcgccuucaacacccgccgccaaccccucuucgcccacguacgccgacgcggcgaaucacgaguauaa

SEQ ID NO: 39578 - RNA, 807 nt, Artificial Sequence
  derived and/or modified sequence opt11 from capsid_protein_VP2__Norovirus__AGE89557
auggcgggcgcguucuucgccggacucgcgagugacguccugggcucaggccugggcucgcucauaaacgcaggcgcgggcgcaaucaaccagaaaaucgacuucgagaacaaccgcaagcuccaacaagccagcuuccaauucagcucgaaccugcaacaggcaucauuccaacacgacaaagagaugcuacaagcgcaaauagaagcaaccaagaaacuacaacaggaaaugaugaaggucaagcaagcgaugcugcucgagggcggauucucagaaacggacgcagccagaggcgcgaucaacgcccccaugacaaaagugcuagacuggucgggcacacgcuacugggcgcccgacgcaaggacaacgaccuacaacgcgggaagguucucaaccccgcaaccaagcgggacccuaccaggacgcauaaacccccgcacgccuacgcccgcgcgcggguccucaagcacgagcucgaacgcaagcaccgcaacgagcauauacucaaaccaaaccgugagcacgcgccugggcuccaccgcaggaucaggcacgaacguaagcucgcuccccagcacagccagaaccaggagcugggucgaggaccagaacagaaaccuaagcccguucaugcgaggggcccacaacauauccuucgucacgcccccaagcucacgaucgagcucccaaggcaccgugagcacagucccgaaagagguccuagacucauggacgggagcauucaacaccaggcgacagccccuguucgcacacauacgcaggcgcggggaaucacgcguauga

SEQ ID NO: 39579 - RNA, 807 nt, Artificial Sequence
  derived and/or modified sequence opt11 from capsid_protein_VP2__Norovirus__AGE89560
auggcaggcgccuucuucgcaggccucgccuccgacguccucggauccggccucggcucucucaucaacgccggcgccggcgccaucaaccaaaaaaucgacuucgaaaacaaccgaaaacuccaacaagccuccuuccaauucuccuccaaccuccaacaagccagcuuccaacacgacaaagaaaugcuacaagcacaaaucgaagccaccaaaaaacuccaacaagaaaugaugaaaguaaaacaagccaugcuacuagaaggcggauucuccgaaaccgacgccgcccgcggcgccaucaacgcccccaugacaaaaguacucgacuggucaggcacccgcuacugggcacccgacgcucgaacaacaaccuacaacgccggccgcuucucaaccccccaacccuccggaacccuacccggccgcauaaacucccgcacaccaacccccgcccgcggcuccuccagcaccagcucuaacgccucaacagccacauccaucuacuccaaccagaccguauccacccgccucggcuccaccgccggcuccggcacuaacguaagcucacucccauccaccgccagaacccgcuccugggucgaagaccagaaccguaaccucucccccuucaugcgaggagcccacaacaucucauucgucacgcccccauccucccgauccuccucacaaggcacagucucaaccguccccaaagaaguacuagacucauggaccggagccuucaacacccgccgccaaccccucuucgcccacauccgcagacgcggcgaaucacgcgucuag

SEQ ID NO: 39580 - RNA, 807 nt, Artificial Sequence
  derived and/or modified sequence opt11 from capsid_protein_VP2__Norovirus__AGE89563
auggcgggcgcauucuuugccggacucgcaagcgacguccugggcucgggacugggaucgcuuauuaacgcgggcgcgggcgcaaucaaccaaaagaucgacuucgaaaacaaccgcaagcuacaacaagccagcuuccaauucagcucgaaccuccaacaggcaucauuccagcacgacaaagagaugcugcaagcccaaauagaagcgaccaagaaacugcaacaagaaaugaugaaagucaagcaagcaaugcugcuagagggcggguucucggaaacagacgcagccagaggcgcaaucaacgccccaaugacgaaaguacuagacuggucgggcacgcgcuacugggcacccgacgccaggaccacgaccuacaacgcgggccgauucucgaccccacaaccauccggaaugcugcccgggcgcauaaacccgcgcacgcccacgcccgcccgcgggagcucgagcacaagcucgaacgcaaguacagccaccagcauacacucaaaccagacugugagcacgcgccugggcucgaccgcgggcucgggcacgaacgugagcucgcucccaagcacagccaggaccagaagcugggucgaggaccagaacaggaaccugagcccguucaugcgaggggcacacaacauauccuucgucacgcccccguccucacgcucaagcucgcaaggaaccguaucuacagucccgaaagagguccuagacucguggacgggcgcauucaacaccagacgacagccccuguucgcgcacauacgcaggcgcggagaaucgcgcguguga

SEQ ID NO: 39581 - RNA, 807 nt, Artificial Sequence
  derived and/or modified sequence opt11 from capsid_protein_VP2__Norovirus__AGE89566
auggcgggcgcguucuucgccggacuagcgagcgacguccugagcuccggccuaggcucgcucauaaacgcgggagcgggagcaaucaaccaaaagaucgacuucgagaacaaccguaagcuccaacaagcgagcuuccaauucagcucgaaccugcaacaggccucguuccaacacgauaaagagaugcuccaagcgcaaauagaagcgaccaagaaacuacaacaggaaaugaugaaggucaagcaagcaauguuacucgagggcggguucucggaaacagacgcggccagaggcgcgaucaacgccccgaugacgaaagugcucgacuggucgggcacgcgauacugggcgcccgacgccaggaccacgaccuacaacgcgggcagguucucaaccccgcaaccgagugggacccugccagggcgaauaaacccgcgcauccccacgcccgcgcgcgggagcucaagcacgagcucaaacgcaagcacggccacgagcauauacucaaaccagaccgugagcacgcgcuugggcucaaccgcaggcucgggcacgaacgugagcucacucccgagcacggcaaggacccgaagcugggucgaggaccaaaaccgaaaccuaagcccauucaugcgcggggcccacaacaucagcuucguaacacccccgagcucgcgcucaagcucacaaggaacagugagcacggucccaaaagaagucuuggacucguggaccggagcguucaacaccaggcgacagccccucuucgcgcacauacgcaggagaggggaaucgcgaguguga

SEQ ID NO: 39582 - RNA, 807 nt, Artificial Sequence
  derived and/or modified sequence opt11 from capsid_protein_VP2__Norovirus__AGE89569
auggcuggcgccuucuucgccggccucgccuccgacguccucggcuccggccucggcucgcucaucaacgccggcgcaggcgccaucaaccaaaaaaucgacuucgaaaacaaccgcaaacuccaacaagccuccuuccaauucuccucaaaccuacaacaagccuccuuucaacacgacaaagaaaugcuccaagcccaaauagaagccaccaaaaaacuacaacaagaaaugaugaaagucaaacaagccaugcuccucgaaggaggauucuccgaaaccgacgccgccagaggcgccauaaacgcccccaugaccaaaguacucgacuggucaggcacccgcuacugggcccccgacgcccgaaccaccaccuacaacgccggcagauucucaacuccccaacccuccggaacccuacccggccgcauaaacccccgaacaccaacccccgcccgcgguuccucauccaccuccuccaacgcauccaccgcaacauccauauacuccaaccaaaccgucuccacacgccuaggcuccaccgccggcuccggcaccaacgucuccucacucccguccaccgcccgcacccgauccugggucgaagaccaaaaccgaaaccuuuccccauucaugcgcggcgcccacaacaucuccuucgucacaccaccauccucccgcuccuccucccaaggcaccguauccacagucccaaaagaaguccucgacucuuggacaggcgccuucaacacacgacgccaaccccucuucgcccacauccgacgacgaggcgaaucccgcgucuaa

SEQ ID NO: 39583 - RNA, 807 nt, Artificial Sequence
  derived and/or modified sequence opt11 from capsid_protein_VP2__Norovirus__AGE89572
auggccggcgccuucuucgccggccuagccuccgacguccuaggcuccggccucggcucacuaauaaacgccggcgcaggagcaaucaaccaaaaaaucgacuucgaaaacaaccgcaaacuccaacaagccuccuuccaauucuccuccaaccuccaacaagccuccuuccaacacgacaaagaaaugcugcaagcccaaaucgaagccacaaaaaaacuccaacaagaaaugaugaaagucaaacaagcaaugcuucucgaaggcggcuucucagaaaccgacgccgcccgcggcgccaucaacgcccccaugaccaaaguccucgacugguccggcacacgcuacugggccccagacgcccgaaccaccaccuacaacgccggccgcuucucaaccccccaacccuccggcacacuacccggccgcaucaacccccgcacccccacacccgcacgcggauccuccuccaccagcucaaacgccucaaccgccaccagcaucuacucaaaccaaaccgucuccacccgccuaggcucgaccgccggauccggcaccaacguauccucacuccccagcaccgcccgaacacgcuccugggucgaagaccaaaaccgaaaccuaucccccuucaugcgcggugcacacaacaucuccuucgucaccccccccuccucccgcuccucaucccaaggcacaguaagcacaguccccaaagaaguccucgacuccuggacaggcgcauucaacacucgccgccaaccccucuucgcacacauccgccgacgcggcgaaucccgcguuuaa

SEQ ID NO: 39584 - RNA, 807 nt, Artificial Sequence
  derived and/or modified sequence opt11 from capsid_protein_VP2__Norovirus__AGE89578
auggccggcgccuucuucgccggccucgccuccgacguccuaggcucaggccucggcucccucauaaacgcaggcgcaggcgcaaucaaccaaaaaauagauuucgaaaacaaccgcaaacuacaacaagcauccuuccaauucuccuccaaccuacaacaagccuccuuccaacacgauaaagaaaugcuccaagcccaaauagaagccacaaaaaaacuacaacaagaaaugaugaaagucaaacaagcaaugcuccucgaaggcggcuucucugaaaccgacgccgcccgcggcgccaucaacgcaccuaugaccaaaguccuagacuggucaggaacacgauauugggcacccgacgcccgcaccacaaccuacaacgccggccgauucucaaccccccaaccauccgguacacuacucgaacgcgucaacccccgcacucccaccccagcacgcggauccucauccaccuccuccaacgccuccaccgccaccagcauccacucaaaccaaaccgucuccacacgccucggcuccacagccggcuccggaaccaacgucuccucacuacccagcaccgcucgcacacgauccugggucgaagaccaaaaccguaaccucucccccuucaugcgcggcgcccacaacaucuccuucgucacaccccccagcucacgcucaagcucacaaggaaccguaucaaccguccccaaagaaguccucgacucauggaccggcgcauucaacacccgccgccaaccccucuucgcccacauccgacgacgcggcgaaucacgcgucuaa

SEQ ID NO: 39585 - RNA, 807 nt, Artificial Sequence
  derived and/or modified sequence opt11 from capsid_protein_VP2__Norovirus__AGE89581
auggccggcgccuucuucgccggccucgccucagacguccucggcuccggucucggcucccucaucaacgcaggcgcaggcgccaucaaccaaaaaaucgacuucgaaaacaaccgcaaacuccaacaagcuagcuuccaauucuccuccaaccuccaacaagccucauuccaacacgacaaagaaaugcuccaagcccaaaucgaagccacaaaaaaacuacaacaagaagucaugaaagucaaacaagccaugcuccucgaaggcggauucagcgaaacagacgccgcccgcggcgccaucaacgccccaaugaccaaaguacuagacugguccggcacccgcuacugggcccccgacgcccgaaccacaaccuacaacgccggcagauucucaaccccccaaccauccggcacccuccccggccgcaucaacccccgcacaccuaccccagcacgaggcuccuccagcaccuccuccaacgcaucaaccgccaccuccaucuacuccaaccaaacagucagcacacgccucggcuccaccgccggcuccggcaccaacguaagcucacuaccaagcaccgcccgaacacgaucaugggucgaagaccaaaacagaaaccucucccccuucaugcgcggcgcccacaacaucuccuucgucaccccaccauccucccgcuccuccucacaaggcaccguaaguaccguccccaaagaaguccuagacuccuggacaggcgcauucaacacaagacgccaaccucucuucgcccacauccgccgccgcggcgaaucccgcgucuaa

SEQ ID NO: 39586 - RNA, 807 nt, Artificial Sequence
  derived and/or modified sequence opt11 from capsid_protein_VP2__Norovirus__AGE89587
auggcaggcgcauucuucgccgggcuagccagcgacgucuuaggcucgggccuaggcucacuaauaaacgcaggcgcaggcgcgauaaaccagaaaauagacuucgaaaacaaccgcaagcuccaacaagcguccuuccaauucagcucaaaccugcaacaagcaucauuccagcacgacaaagagaugcuacaagcgcaaauagaagccaccaagaaacugcaacaagaaaugaugaagguaaagcaagccaugcuacuagaaggcggauucucagaaacggacgcggccagaggcgcaaucaacgccccaaugacgaaagugcucgauuggucaggcacgcgcuacugggcacccgacgcacggaccacgaccuacaacgcgggccgauucucgaccccacaaccgagcggaaugcuacccgggcgcauaaacccgcgcacgcccacacccgcacgcgggagcucaagcacaagcucaaacgcgagcacggccaccagcauacacuccaaccagaccguaagcacacgccuaggcucgaccgcgggcuccggcacaaacgugagcucacucccauccacagccaggaccagaagcugggucgaggaccaaaaccgcaaccugagcccauucaugcgcggagcccacaacaucagcuucgucacgccaccguccucgcgcucaagcucgcaaggcaccguaagcacaguccccaaagaagucuuagacucauggacgggagcauucaauaccagacgccaaccacuguucgcacacauacgcagacgcggggaaucgcgcguauaa

SEQ ID NO: 39587 - RNA, 807 nt, Artificial Sequence
  derived and/or modified sequence opt11 from capsid_protein_VP2__Norovirus__AGE89590
auggcgggcgcauucuucgcagggcuugcaagcgacgucuugggcucaggccugggaucacucauaaacgcgggcgcgggcgcgaucaaccagaaaaucgauuucgagaacaaccgcaagcuccaacaagcgagcuuucaauuuagcucgaaccuacaacaggccucguuccagcacgacaaagagaugcugcaagcgcaaauugaagcgacaaagaaacugcaacaggaaaugaugaaggucaagcaagcgaugcugcucgagggcggguucucggaaacggacgcggccaggggagcgaucaaugccccgaugacgaaagugcucgauuggucgggaacgcgcuauugggcgcccgaugccagaacaacgaccuacaacgcgggaagauucucgaccccgcaaccgagcggaacccugcccgaacgugugaacccgcgcacgcccacaccagcgcgcgggagcucaagcacgagcucgaacgcgaguacggcaacgagcauacacucgaaccagaccgugagcacgcgccugggcucaaccgcgggcucaggcacgaacgucagcucgcucccgagcacggccagaaccaggaguugggucgaggaccagaacaggaacuugagcccguucaugcgcggggcccacaacauuagcuuugucacgcccccgagcucgcgcucgagcucacaaggaaccguaagcacggucccgaaagagguccuugacucguggacgggcgcguucaauaccagacgccagcccuuguucgcgcacauacguagacgcggggaaucgcgaguguga

SEQ ID NO: 39588 - RNA, 807 nt, Artificial Sequence
  derived and/or modified sequence opt11 from capsid_protein_VP2__Norovirus__AGE89593
auggcaggcgccuucuucgccggacuagcaagcgacguacuaggcucgggccucggcucacucauaaacgccggcgcaggcgcaaucaaccaaaaaaucgacuucgaaaacaaccgcaaacuccaacaagcaagcuuucaauucagcucaaaccuacaacaagccucauuccaacacgacaaagaaaugcuacaagcacaaauagaagcaaccaaaaaacuacaacaagaaaugaugaaagucaaacaagccaugcuacuagaaggcggcuucucagaaaccgacgcagcccgaggcgccaucaacgcccccaugaccaaaguccucgacuggucaggcacccgcuacugggcccccgacgcccgaaccaccaccuacaacgccggcagauucuccacaccacaaccaagcggcacccuccccggacgcauaaacccacgaacacccacacccgcacgaggcagcuccagcaccuccucaaacgccagcaccgccacauccauacacuccaaccaaaccgugagcacccgacuaggcucaacagcaggcuccggcaccaacguaagcucccuaccaagcaccgcccgcacuagaagcugggucgaagaccaaaaccgaaaccugagcccauucaugcgcggcgcccacaauauaagcuucgucaccccccccagcucccgaucauccucgcaaggaaccguaagcaccguccccaaagaaguccucgacucauggacgggcgcauucaacacacgccgccaaccccucuucgcacacauccgcagacgaggagaaucgcgagucuaa

SEQ ID NO: 39589 - RNA, 807 nt, Artificial Sequence
  derived and/or modified sequence opt11 from capsid_protein_VP2__Norovirus__AGE89596
auggcgggcgcguucuuugccgggcucgcgagcgacguccugggcucgggccugggaucgcuaauaaacgcgggcgcgggcgcgauaaaucaaaagguagaguucgagaacaaucguaagcuccagcaagccagcuuucaauuuaguucgaaccugcaacaagcaucauuccaacacgacaaagagauguugcaagcgcaaauagaagcgacaaagaaacugcaacaggaaaugaugagggucaagcaagcaauguugcucgagggcggguucucagaaacagacgcggccaggggagcgaucaaugcaccaaugacaaaaacgcucgauuggucaggcacgcgcuauugggcgcccgacgccaggaccacaaccuauaacgcgggaagguucucgaccccgcaaccgagcggggcccugcccgggcgcgcgaaccugcgcgcgaccgugcccgcacgaggaagcucgagcacgagcucaaacucgagcauagccacgagcguguacucgaaccagaccacgagcacacgcuugggcucgaccgcaggcucgggcacgagcgugagcucacucccgagcacagccaggaccagaagcuggguagaggaccagaacaggaaccugagcccguucaugcgcggggcccacaacaucagcuuugucacucccccaagcucacgcucgagcucacaagggaccguaagcacggucccgaaagaaguauuggacucauggacaggcgcguucaauacaaggcgccagccccuguucgcgcacauacgcaaacgcggagaaucacguguguga

SEQ ID NO: 39590 - RNA, 807 nt, Artificial Sequence
  derived and/or modified sequence opt11 from capsid_protein_VP2__Norovirus__AGE89599
auggcgggcgcauucuucgccggacucgcaagcgacguccuaggcucaggccugggcucgcucauaaacgcaggcgcaggcgcgaucaaccagaaaaucgacuucgagaacaaccgcaaacuacaacaagccagcuuccaauucagcucaaaccugcaacaagcaucguuccagcacgacaaagagaugcuacaagcacaaauagaagcaaccaagaaacuccaacaagaaaugaugaaagucaaacaagcaaugcuacucgaaggcggauucuccgaaacagacgcggcaagaggcgcaaucaacgccccaaugacgaaaguacucgacuggucgggcacacgcuacugggcacccgacgccaggaccacaacauacaacgcaggccgguucucaaccccgcaaccaagcggaacccuacccggacgcacgaacccacgaacacccacgcccgcacgaggaagcucaagcauaagcucgaacgcaagcacggccacauccauccacucgaaccagaccgugagcacacgacuaggcucaaccgcaggcucaggcacaaacguauccucgcuaccaagcacagccaggaccagauccugggucgaggaccaaaaccggaaccuaagcccauucaugcgcggggcacacaacaucagcuucgucacacccccauccucacgcucauccucacaagggaccguaagcacagucccgaaagaaguacuggacucauggacaggcgccuucaacaccaggcgccagccccuauucgcacacauacgcagacgcggggaaucgcgcguauaa

SEQ ID NO: 39591 - RNA, 807 nt, Artificial Sequence
  derived and/or modified sequence opt11 from capsid_protein_VP2__Norovirus__AGE89602
auggccggagccuucuucgccggccucgcaagcgacguccuaggcucaggacuaggcucccucaucaacgcaggcgccggcgcgaucaaccaaaaaaucgacuucgaaaacaaccgcaaacuccaacaagccuccuuccaauucagcuccaaccuccaacaagccuccuuccaacacgacaaagaaauguuacaagcccaaaucgaagcaaccaaaaaacuacaacaagaaaugaugaaagucaaacaagccaugcuccucgaaggcggcuucucagaaacagacgcagcccgcggcgcaaucaacgcccccaugaccaaaguccuagacuggucgggcacccgcuacugggcacccgacgcccgcaccaccacauacaacgcaggccgcuucucaaccccccagccaagcggcacccuacccggccgcaucaacccccgcacccccacgcccgcccgcggauccucauccaccuccucaaacgccuccaccgccaccucaauccacuccaaccaaaccgccuccacccgccucggcucaaccgcaggcucaggcacaaacgucuccucacuccccagcaccgcccgaaccagaagcugggucgaagaccaaaaccgaaaccucuccccauucaugcgcggcgcccacaacaucucauucgucaccccccccuccucccgcuccuccucccaaggaaccgucagcacagucccaaaagaaguccuagacuccuggaccggcgccuucaacacccgccgucaacccuuauucgcacacauccgccgacguggagaaucccgcguauaa

SEQ ID NO: 39592 - RNA, 807 nt, Artificial Sequence
  derived and/or modified sequence opt11 from capsid_protein_VP2__Norovirus__AGE89605
auggcaggcgcauucuucgccggacucgccuccgauguccugggcucaggccugggcucccucauaaacgcaggcgccggcgcaauaaaccagaaaauagacuucgaaaacaaccgcaagcuccaacaagccagcuuccaauuuagcuccaaccuccaacaagcaucauuccaacacgacaaagaaaugcuacaagcacaaauagaagccaccaagaaacuccaacaagaaaugaugaaagucaaacaagcaaugcuccucgaaggcggauucucagaaacagacgcagcaaggggcgcaaucaacgccccaaugaccaaagugcucgacuggucaggcacacgcuacugggcaccagacgcaagaacaacaaccuacaacgcgggcagauucuccacaccacaacccagcggaacccugcccggacgcauaaacccccgcacacccacacccgcacgcggaagcuccagcacaucaucaaacgcaagcaccgccacaagcauccacuccaaccaaaccgucagcacacgccucggcucaaccgcaggcucaggcacaaacguaagcucacuccccuccaccgcaagaacccgcagcuggguagaagaccaaaaccgaucccucagcccauucaugcgaggagcacacaacaucagcuucgucacaccacccagcucacgaucguccucacaaggaaccgucagcacaguccccaaagaaguccuagacucauggacaggagccuucaacaccaggcgccagcccuuauucgcacacauacgcagacgcggagaaucacgaguauaa

SEQ ID NO: 39593 - RNA, 807 nt, Artificial Sequence
  derived and/or modified sequence opt11 from capsid_protein_VP2__Norovirus__AGE89608
auggcaggcgcguucuucgcugggcucgcgagcgacguacuaggcucgggauugggcucgcuaauaaacgcgggagcgggcgcgauaaaccagaaaaucgacuucgagaacaaucgcaagcuccaacaagccagcuuccaauucagcucaaaccuacaacaagcaucguuccagcacgacaaagagauguuacaagcgcaaauagaagcgaccaagaaacugcaacaggaaaugaugaaagucaagcaagcgaugcugcucgagggcggauucucagaaacggacgcagcaagaggagcgaucaacgccccgaugacgaaagugcucgacuggucgggcacacgcuacugggcacccgacgccaggaccacaaccuacaacgcgggcagguucucgaccccacaaccaagcgggacccuacccgggcgcaucaacccacgcacacccacaccagcacgcgggagcucgagcacuagcucaaacgcgagcacagccaccagcauacacucaaaccagaccguaagcacgcgccugggcuacacagcgggcucaggcacgaacguaagcucgcucccgagcaccgcccgaaccaggagcugggucgaggaccaaaacagaagccuaaguccauucaugcgcggagcccacaacaucagcuucgucacgcccccaagcucgcgcucgagcucacaaggaacaguaagcacagucccgaaagaaguccuagacucguggacaggcgcguucaauaccagacgccagccccuguucgcacacauacgaaggcgcggggaaucgcgcguguga

SEQ ID NO: 39594 - RNA, 807 nt, Artificial Sequence
  derived and/or modified sequence opt11 from capsid_protein_VP2__Norovirus__AGE89611
auggccggagcauucuucgccggacuagcauccgacguccucggcuccggccucggcucccucaucaacgcaggagccggagcaaucaaucaaaaaaucgacuucgaaaacaaccgcaaacuccagcaagccuccuuccaauucagcucaaaccugcaacaagccucguuccaacacgacaaagaaaugcuccaagcacaaaucgaagcaaccaaaaaacuccaacaagaaaugaugaaagucaaacaagcaaugcuccucgaaggcggcuucucagaaacagacgcagcccgaggcgcaaucucagccccaaugacaaaaguacuagacuggucaggcacccgauacugggcacccgacgccagaacaacaaccuacaacgccggccgauucucaaccccacaaccauccgggacccuaccaggccgcauaaacccccgcacaccaacacccgcacgaggauccucaagcacaagcucaaacgcaccaacagccacaagcaucuacuccaaccaaaccguaagcacacgccuaggcucaaccgcaggcucaggcacaaacgucagcucacucccauccacugcaagaacccgaagcugggucgaagaccaaaacaggaaccuaagcccauucaugcgaggggcccacaacaucuccuucgucacacccccguccucacgcucaagcucacaaggaaccguaagcacaguccccaaagaaguccuagacucauggaccggagccuucaacacccgacgccagccccucuucgcacacauacgccgacgcggcgaaucacgcgucuga

SEQ ID NO: 39595 - RNA, 807 nt, Artificial Sequence
  derived and/or modified sequence opt11 from capsid_protein_VP2__Norovirus__AGE89614
auggccggcgccuucuucgccggccucgccagcgauguccuuggcucaggccuaggcucacucaucaacgccggcgccggcgccauaaaccaaaaaaucgacuucgaaaacaaccgaaaacuccaacaagccucauuccaauucuccucuaaccuacaacaagccuccuuccaacacgacaaagaaaugcuccaagcccaaaucgaagccaccaaaaaacuccaacaagaaaugaugaaagucaaacaagccaugcuccucgaaggcggcuucuccgaaaccgacgccgcccgaggcgccaucaacgcccccaugaccaaaguacucgacuggucaggcacccguuacugggcaccagacgccagaaccaccaccuacaacgccggccgcuucucaaccccccaaccaucugaaacccuccccggccgcauaaacccccgaacccccacccccgcacgcggcagcuccuccaccucauccaacgccucaaccgccacuuccauccacucgaaccaaaccguaagcacccgccucggauccaccgccggcuccggaaccaacgucuccucacuccccuccaccgcccgaacacgauccuggguagaagaccaaaaccgaucccuaagccccuucaugcgcggcgcccacaacaucuccuucgucacaccccccagcucccgcuccuccucccaaggcaccgucuccaccguacccaaagaaguccucgacuccuggaccggcgcauucaacaccagacgccaaccccucuucgcccacauccgccgccgcggagaaucacgcgucuaa

SEQ ID NO: 39596 - RNA, 807 nt, Artificial Sequence
  derived and/or modified sequence opt11 from capsid_protein_VP2__Norovirus__AGE89617
auggcaggcgccuucuucgccggccuagccuccgacguccucggcuccggccucggaucgcucauaaacgccggcgcaggagcaaucaaccaaaaagucgaauucgaaaacaaccgcaaacuccaacaagccagcuuccaauucuccucaaaccuacaacaggccuccuuccaacaugacaaagaaaugcuccaagcccaaauagaagcaaccaaaaaacuccaacaagaaaugaugcgagucaaacaagcaaugcuccucgaaggcggcuucuccgaaaccgacgccgcccgcggcgccaucaacgccccaaugacaaaaacacucgacugguccggaacccgcuacugggcacccgacgcccgcaccaccaccuacaacgccggccgcuucuccaccccccaaccguccggcgcccucccuggccgcgcaaaccuccgcgccacaguccccgcccgcggauccuccuccaccucauccaacuccucaaucgccaccuccgucuacucaaaccaaaccacuucaacccgccuuggauccacagcuggaucaggcacaagcgucuccucccuacccuccaccgcccgaacccgcuccuggguagaagaccaaaaccgaaaccucagcccauuuaugcgcggcgcccacaacaucuccuucgucaccccccccuccucccgcuccuccucacaaggcaccguaagcaccgucccaaaagaaguccuagacucauggacaggcgcauucaacacacgccgccaaccccuauucgcccacauccgcaaacgcggcgaaucccgcgucuaa

SEQ ID NO: 39597 - RNA, 807 nt, Artificial Sequence
  derived and/or modified sequence opt11 from capsid_protein_VP2__Norovirus__AGE89620
auggcaggcgcguucuucgccgggcucgcgagcgacgucuugggcucgggccugggaucgcucauaaacgcgggcgcgggcgcgauuaaucaaaagaucgacuucgagaacaaccgcaagcuccagcaagcgagcuuccaauucagcucgaacuugcaacaggccucauuccaacacgacaaagagaugcugcaagcgcaaauagaagcaaccaagaaacugcaacaggaaaugaugaaggucaaacaagcgaugcugcucgagggcggguucucggaaacagacgcagccagaggcgcgaucaaugccccgaugacaaaaguacuugacuggucgggcacgcgcuacugggccccagacgcccggaccacgaccuauaacgcgggcagguucucgaccccgcaaccgagcgggaccuugccagggcgcguaaacccacgcacacccacgccagcgcgcgggagcucgagcacgagcucgaacgcgagcauagccacgagcauauacucgaaccagaccguaagcacgcgcuugggcucgaccgcaggcucaggcacgaacguaagcucacucccgagcacggccagaaccagaagcugggucgaggaccagaacagaaacuugagcccauucaugcgcggggcacauaacauuagcuucgucacgcccccgagcucgcgaucgagcucacaagggaccguauccacggucccgaaagaaguccuggacucguggacgggcgcguucaacaccaggcgacagccccuguucgcgcacauacgcagacgaggggaaucccgcguauga

SEQ ID NO: 39598 - RNA, 807 nt, Artificial Sequence
  derived and/or modified sequence opt11 from capsid_protein_VP2__Norovirus__AGE89623
auggcaggcgcauucuucgccggacucgcgagcgacguacuaggcucaggccugggcucacucauaaacgcgggcgcgggcgcaaucaaccaaaaagucgaguucgagaacaaccgcaaacuccaacaagcgagcuuccaauucuccucaaaccugcaacaagccucguuccagcacgacaaagagaugcuacaagcgcaaauagaagcgacaaagaaacuacaacaagaaaugaugagggucaaacaagcgaugcuacucgagggaggauucucggaaacggacgcggccagaggcgcaaucaacgccccgaugaccaaaacgcucgacugguccggcacgcgcuacugggcgcccgacgccaggaccacaaccuacaacgcgggcagauucucgaccccgcaaccaagcggagcccuacccggacgcgcgaacuuacgcgcaaccgugcccgcacgcggauccuccagcacauucucgaacucaagcauagcaacaagcguguacucaaaccagaccacaagcacgcgccugggcucgaccgcgggcucaggcacgagcgugagcucacucccaagcacagccagaacccgaagcuggguagaagaccaaaacagaaaccugagcccauucaugcgcggggcccacaacauaagcuacgucacgccuccaagcucgcgcucaagcucgcaagggaccgucagcacagucccgaaagagguccuagacucguggacgggcgcguucaacacccggcgccagccccuguucgcacacauccgcaagcguggcgaaucgcgcguguaa

SEQ ID NO: 39599 - RNA, 807 nt, Artificial Sequence
  derived and/or modified sequence opt11 from capsid_protein_VP2__Norovirus__AGE89626
auggcaggcgccuucuucgccggccuagccuccgacguccuaggcuccggccuaggcucccucauaaacgccggcgccggcgccaucaaccaaaaagucgaauucgaaaacaaccgaaaacuccaacaagccagcuuccaauucagcucaaaccuucaacaagccuccuuccaacacgacaaagaaaugcuccaagcacaaaucgaagccaccaagaaacuacaacaagaaaugaugagagucaaacaagccaugcuacucgaaggcggcuucucagaaaccgacgccgcccgcggcgccaucaacgcccccaugaccaaaacccucgacuggucaggcacccgcuacugggcaccagacgcacgcaccaccacauacaacgccggccgcuucucaaccccacaacccagcggagcacuacccggacgcgccaaccuccgcgcaaccgucccagcccgcggcagcuccuccaccuucuccaacuccuccauagccaccuccgucuacuccaaccaaaccaccuccacacgucucggcucgaccgcaggcuccggcacauccgucuccucacucccaucaaccgcccgaaccagaagcugggucgaagaccaaaaccgaaaccuaagcccauucaugcgaggcgcccacaacauaucauucgucacccccccgagcucccgcucgagcucccaaggcacaguauccaccguccccaaagaaguacuagacuccuggaccggagcauucaacacccgccgccaaccccucuucgcccacauaagaaaacgcggagaaucacgcguauaa

SEQ ID NO: 39600 - RNA, 807 nt, Artificial Sequence
  derived and/or modified sequence opt11 from capsid_protein_VP2__Norovirus__AGE89629
auggccggcgccuucuucgcaggccucgccuccgauguccucggauccggccucggcucacuaaucaacgccggcgcaggcgcaaucaaccaaaaagucgaauucgaaaacaaccgcaaacuccaacaagcauccuuccaauucuccuccaaccuccaacaagccucauuccaacacgacaaagaaaugcugcaagcucaaaucgaagccaccaaaaaacuccaacaagaaaugaugcgagucaaacaagccaugcuccuagaaggcggcuucuccgaaaccgacgccgcccgcggcgccaucaacgccccaaugacaaaaacacuagacugguccggaacacgcuacugggcacccgacgcccgaaccaccaccuacaacgccggcagguucuccaccccacaacccuccggcgcccuacccggcggcgcaaaccuacgcgcaaccguacccgcacgcggauccuccagcacuuucucaaacuccucaaucgccaccagcgucuacucaaaccaaaccaccuccacacgccucggcucgaccgccggcucaggcacauccguauccucacuacccuccaccgcccgaacccgcuccugggucgaagaccaaaaccgcaaccucucccccuucaugcgcggagcccacaacaucuccuucgucaccccacccuccucacgcuccuccucccaaggaacugucuccacagucccaaaagaaguccuagacucguggacuggcgcauucaacacccgacgccaaccccuauucgcccacauacgaaaacgcggcgaaucccgaguauaa

SEQ ID NO: 39601 - RNA, 807 nt, Artificial Sequence
  derived and/or modified sequence opt11 from capsid_protein_VP2__Norovirus__AGE89635
auggcaggcgcauucuucgccggacucgcauccgacguccugggcuccggcuugggaucacuaauaaacgcgggcgcaggcgcgauaaaccaaaagauagacuucgaaaacaaccgcaagcuccagcaagccagcuuccaauucagcuccaaccuacaacaggccucauuccaacacgacaaagagaugcuacaagcacaaauagaagcaaccaagaaacuacaacaggaaaugaugaaagucaaacaagcaaugcugcuagaaggcggauucucagaaacggacgcggccagaggcgcgaucaacgccccgaugacaaaagugcucgacuggucgggaacgcgcuacugggcacccgacgccagaacaacaaccuacaacgcgggcagguucucgaccccgcaaccgagcggaaccuugccagggcgcauaaacccgcgaacgcccacacccgcgcgcgggagcuccagcaccagcucaaacgcaagcacggccacgagcauacacuccaaccagaccguaagcacgcgccuaggcucgaccgcaggaucgggcacgaacguaagcucgcucccgagcacagccagaaccaggagcugggucgaggaccaaaacagaaaccuaagcccguucaugcgcggagcccacaacaucagcuucgucacgcccccuagcucacgcucgagcucgcaagggaccgugagcacggucccgaaagagguccuagacucguggacgggcgcauucaacacaaggcgacagccccuguucgcacacauacgcaggcgcggggaaucgcgcguauga

SEQ ID NO: 39602 - RNA, 807 nt, Artificial Sequence
  derived and/or modified sequence opt11 from capsid_protein_VP2__Norovirus__AGE89638
auggcaggcgcauucuucgccggacucgcaagcgacguccucggcucaggccuaggcucacucauaaacgccggagcaggcgcaauaaaccaaaaaaucgacuucgaaaacaaccgcaaacuacaacaagcaagcuuccaauucagcucaaaccuacaacaagccuccuuccaacacgacaaagaaaugcuccaagcccaaaucgaagcaaccaagaaacuccaacaagaaaugaugaaagucaaacaagccaugcuacucgaaggcggcuucucagaaaccgacgcagcccgaggcgcaaucaacgccccaaugacgaaaguacuagacugguccggcacacgcuacugggcccccgacgccagaaccacaacuuacaacgccggacgauucucaaccccacaacccuccggcacccuacccggacgcaucaacccccgcacacccacccccgcacgcggaagcucaagcacaagcuccaacgcaagcacagccacaagcauacaccucaaccaaaccguaagcacacgccuaggcuccaccgcaggcucaggcaccaacguaaguucacuccccuccaccgcccgaacccgcuccugggucgaggaccaaaaccgaaaccuaagcccauucaugcgcggcgcccacaacaucagcuucgucacacccccaagcucacgcucaagcucgcaaggcaccgucagcacagucccaaaagaaguccuagacuccuggacaggagcauucaacacccgccgccaaccccucuucgcgcacauacgcagacgcggagaaucacgcguauaa

SEQ ID NO: 39603 - RNA, 807 nt, Artificial Sequence
  derived and/or modified sequence opt11 from capsid_protein_VP2__Norovirus__AGE89641
auggcaggcgccuucuucgccggccucgccuccgacguacucggcucaggccuaggcucccuaaucaacgcaggcgccggcgccaucaaccaaaaaaucgacuucgaaaacaaccgcaaacuccaacaagccuccuuccaauucuccuccaaccuccaacaagccucauuccaacacgacaaagaaaugcuccaagcccaaaucgaagcaaccaaaaaacuccaacaagaaaugaugaaagucaaacaagccaugcuacucgaaggcggcuucucugaaacagacgcagcccgaggcgccaucaacgccccaaugacaaaaguccucgacugguccggcacacgcuacugggcccccgacgcacgcacaaccaccuacaacgccggccgauucuccaccccccaacccuccggcacccuacccggccgcaucaacccccgcacccccaccccagcccgcggaucauccuccaccuccucaaacgucucaaccgcuaccuccaucuacucgaaccaaaccgucucaacccgccucggcuccaccgccgguucaggcaccaacgucuccucucucccuucaaccgccagaacccgcagcugggucgaagaccaaaaccgaaaccucagccccuucaugcgcggcgcacacaacaucuccuucgucaccccccccagcucccgcuccuccucccaaggcacugucuccacaguccccaaagaaguccucgacuccuggaccggcgccuucaacacccgccgccaaccccucuucgcccacauccgccgccgcggcgaaucccgcgucuaa

SEQ ID NO: 39604 - RNA, 807 nt, Artificial Sequence
  derived and/or modified sequence opt11 from capsid_protein_VP2__Norovirus__AGE89644
auggcgggcgccuucuucgccggccucgcaagcgacguccucggaucaggccuaggcucccucauaaacgccggcgcaggcgcaaucaaccagaaaaucgacuucgaaaacaaccgcaaacuccaacaagccagcuuucaauucagcuccaaccuccaacaagcaucauuccaacacgacaaagaaaugcuacaagcacaaauagaagcaaccaagaaacuccaacaagaaaugaugaaagucaaacaagccaugcuccucgaaggcggcuucucagaaacagacgcagccagaggcgcaaucaacgccccaaugacaaaaguacucgacugguccggcacacgcuacugggcccccgacgccaggaccacaaccuacaacgcgggccgauucucaacaccccaaccaucaggagcccuccccggacgcauaaacccccgcaccccaaccccugcacgcggaagcuccuccaccagcucgaacgcaagcacagccacaagcauacacucaaaccaaaccguaagcacccgccuaggcucaaccgccggcucaggcaccaacgucagcggccucccaagcacagcccgcaccagaagcugggucgaagaccagaacagaaaccuauccccguucaugcgcggcgcccacaacaucucauucgucacaccaccaagcucaagaucaagcucacaaggaaccguaagcacagucccaaaagaaguccuagacucauggacaggagcauucaacaccagacgccaaccccuauucgcacacauacgcagacgaggcgaaucgcgcguauaa

SEQ ID NO: 39605 - RNA, 807 nt, Artificial Sequence
  derived and/or modified sequence opt11 from capsid_protein_VP2__Norovirus__AGE89647
auggccggcgcuuucuucgccggccuagcaucagacguccucggcuccggccucggcucacuuaucaacgccggagccggcgccaucaaccaaaaaaucgacuucgaaaacaaccgcaaacuccagcaagccuccuuccaauucuccuccaaccuacaacaagcauccuuccaacacgacaaagaaaugcuacaagcccaaaucgaagcaaccaaaaaacuacaacaggaaaugaugaaagucaaacaagcaaugcuccucgaaggcggcuucucagaaaccgacgccgcccgcggcgcaaucaacgcccccaugacaaaaguccucgacugguccggcacccgcuacugggcacccgacgcccgaaccacaaccuacaacgccggccgauucuccaccccacaacccuccggaacccuacccggccgcaucaacccccgcacacccaccccagcacgaggcucauccuccaucuccucuaacgccagcaccgccaccuccauacacucgaaccaaaccguauccacacgccucggcucaaccgccggcucaggcaccaacguuuccuccuucccauccacagcccgcacccgcuccugggucgaagaccaaaaccgaaaccuaucaccauucaugcgcggagcccacaacaucuccuucgucaccccccccuccucccguuccuccucccaaggaaccguauccacagucccaaaagaaguccucgacucauggacaggcgcauucaauaccagacgccaaccccucuucgcccacauccgccgacgcggcgaaucccgcgucuaa

SEQ ID NO: 39606 - RNA, 807 nt, Artificial Sequence
  derived and/or modified sequence opt11 from capsid_protein_VP2__Norovirus__AGE89650
auggcaggcgcguucuucgccggacucgcgagcgacguccuaggaucaggccuaggcucacuaauaaacgcaggcgcgggcgcaauaaaccagaaaaucgacuucgagaacaaccgcaagcuacaacaagccagcuuccaauucagcucaaacuuacaacaagccucauuccagcacgacaaagagaugcugcaagcacaaaucgaagccaccaagaaacugcaacaagaaaugaugaaagucaaacaagcaaugcuacucgagggcggauucucagaaacggacgcagcaagaggcgcaaucaacgccccaaugacgaaaguccucgacugguccggaacacgcuacugggcgcccgacgccagaacuacgaccuacaacgcgggcagauucuccacaccccaaccauccggaaugcugcccggacgcauaaacccacgcacccccacgccagcacgaggaagcuccagcacgagcucaaacgcgagcacagcaacgagcauccacucaaaccaaaccgugagcacgcgccuaggcucaacagcgggaucgggcacgaacguaagcucgcuaccaagcacggccagaaccaggagcugggucgaggaccagaacaggaaccugagcccguucaugcgcggggcccacaacaucagcuucgucacgcccccaagcucccgaucaagcucgcaaggcaccguaagcacagucccaaaagaaguccuggacucauggacgggcgcauucaacacaagacgccagccccuauucgcacacauacguaggcgcggagaaucgcgagucuga

SEQ ID NO: 39607 - RNA, 807 nt, Artificial Sequence
  derived and/or modified sequence opt11 from capsid_protein_VP2__Norovirus__AGE89653
auggcaggcgcguucuucgccggccucgcgagcgacguccugggcucgggccuaggcucacucauaaacgcaggcgcgggcgcgauaaaccaaaagguagaguucgaaaacaaccgaaaacuccaacaagcgagcuuccaauucagcucgaacuugcaacaggccucauuccagcacgacaaagagaugcuacaagcccaaauagaagcgacaaagaaacuacaacaggaaaugaugaggguaaaacaagcaaugcugcucgaaggcggauucucggaaacggacgccgccagaggagcaaucaacgcaccaaugacgaaagcgcucgacuggucaggcacacgcuacugggcacccgacgcuagaaccacaaccuacaacgcaggccacuucucgaccccgcaaucgagcggagcacugcccgggcgcgcgaaccuacgcgcggccgugccagcacgcgggagcucaagcacgagcucaaacucgagcaccgcaacguccguguacucgaaccagaccauaagcacgcgacugggcucgaccgccggcucgggcacgagcguaagcucgcucccaagcacggccagaacaaggagcuggguagaggaccagaacagaaaccucagcccauucaugcguggggcccacaacaucagcuucgucacgccgcccagcucgcgccccagcucgcaagggaccgucagcacggucccgaaagaaguccuggacucauggacaggcgcguucaacaccaggcgccagccccuguucgcgcacauacgcaaacgaggagaaucacgcgcauaa

SEQ ID NO: 39608 - RNA, 807 nt, Artificial Sequence
  derived and/or modified sequence opt11 from capsid_protein_VP2__Norovirus__AGE89656
auggcaggcgcguucuucgccgggcucgcaagcgacguacugggcucaggccugggaucccucauaaacgcgggcgcgggcgcaauaaaccagaaaaucgacuucgaaaacaaccgcaagcuccaacaagcgagcuuccaauucaguuccaaccugcaacaggccucauuccagcacgacaaagagauguuacaagcacaaaucgaagcgaccaagaaacugcaacaagaaaugaugaaggucaagcaagcaaugcugcucgagggcggauucucagaaacagacgcggcaaggggcgcaaucaacgccccgaugacgaaagugcuagacuggucgggcacgcgcuacugggcgcccgacgccaggacaacgaccuacaacgcgggaagguucucgaccccgcaaccgagcgggaccuugcccgggcgcauaaacccgcgcacacccacgccagcacgcgggagcucaagcaccagcucaaacgcgagcacggccacgaguauauacucaaaccagacagugagcacacgccuaggaucgacagcgggcuccggcacaaacgucagcucgcucccaagcacggccaggaccaggagcugggucgaggaccaaaacagaaaccugagcccguucaugcgaggagcccacaauaucagcuucgucacacccccgagcucacgcucauccucgcaagggaccgugagcacggucccgaaagagguccucgacucauggacgggcgcguucaacacacgacgccagccccuauucgcgcacauacgcagacgcggagaaucacgcgucuga

SEQ ID NO: 39609 - RNA, 807 nt, Artificial Sequence
  derived and/or modified sequence opt11 from capsid_protein_VP2__Norovirus__AGE89659
auggccggcgcauucuucgccggacucgcauccgacguccuaggcucgggccuaggcucacucauaaacgccggcgcgggagccaucaaccagaaaaucgacuucgaaaacaaccgcaaacuccaacaagcaagcuuccaauucagcuccaaccuccaacaggccucguuccaacacgacaaagaaaugcuacaagcacaaaucgaagcgaccaaaaaacuccaacaagaaaugaugaaagucaaacaagcaaugcuccucgaaggcggauuuucagaaacagacgcagccagaggcgcaaucaacgcccccaugacaaaaguacucgacuggucaggcacacgcuacugggcacccgacgcccgaaccacaaccuacaaugcaggcagauucucaaccccacaaccaagcggaacccuccccgggcgcauaaacccccgaaucccaacacccgcccgaggauccuccagcaccagcucuaacgccagcaccgccacaucaauauacucaaaccaaaccgucuccacacgccuaggcuccgccgcaggcucaggcacaaacguaagcucacuccccagcaccgcccgaacccgaagcugggucgaagaccaaaacagaaaccuaagcccguucaugcgcggagcccacaacauaagcuucgucacacccccaagcucucgcucgagcucacaaggcaccgucagcacggucccaaaagaaguccuagacucauggacaggcgcguucaacacacgacgccaaccccucuucgcccacauacgccgacgcggggaaucgcgcguauaa

SEQ ID NO: 39610 - RNA, 807 nt, Artificial Sequence
  derived and/or modified sequence opt11 from capsid_protein_VP2__Norovirus__AGE89662
auggccggagccuucuuugccggacucgccuccgacguccucggcuccggccuaggcucccuaaucaacgccggcgccggagccaucaaccaaaaaaucgacuucgaaaacaaccgcaaacuccaacaagccuccuuccaauucuccuccaaccuacaacaagccuccuuccaacacgacaaagaaaugcuucaagcacaaaucgaagccaccaaaaaacuccaacaagaaaugaugaaagucaaacaagccaugcuccuagagggaggauucucagaaaccgacgccgcccgcggcgccaucaacgcccccaugacaaaaguucucgacugguccggcacacgcuacugggcaccagacgcacgcaccacaaccuacaacgccggccgcuucuccaccccacaacccuccggaacccuaccaggccgcaucaacccccgaacccccacacccgcccgcggcagcuccaacacauccucaaacgccagcaccgccaccuccauccacucaaaccaaaccgucuccacccgccuaggcuccaccgccggcucgggcacaaacgucuccucccuccccuccaccgcccgcacacgauccugggucgaagaccaaaaccgaaaccucuccccauucaugcgaggcgcccacaacaucucauucguaaccccccccuccucccgcucauccucccaaggcaccgucuccaccguccccaaagaaguccucgacucuuggacaggcgcauucaacaccagacgccaaccccucuucgcccacauccgccgucgcggcgaaucacgcguauaa

SEQ ID NO: 39611 - RNA, 807 nt, Artificial Sequence
  derived and/or modified sequence opt11 from capsid_protein_VP2__Norovirus__AGE89665
auggcaggcgcauucuucgccggacuugcgucagacguccuaggcucaggucugggcucacucauaaacgccggcgccggcgcaaucaaccaaaaaaucgacuucgaaaacaaccgcaaacuccaacaagccagcuuccaauucagcuccaaccuccaacaagccucauuccaacacgacaaagaaaugcuccaagcccaaaucgaagcgaccaaaaaacuccaacaagaaaugaugaaagucaagcaagccaugcuacucgaaggcggauucuccgaaacagacgcagcccgaggcgcaaucaacgcccccaugaccaaaguacucgacugguccggcacacgcuacugggcccccgacgcccgaaccacgaccuacaacgccggccgguucuccacaccccaaccauccggaacccuucccggccgcguaaacccccgcacacccacacccgcccgcggcuccucaagcacauccucaaacgccagcaucgccacaagcauauacucaaaccaaaccguauccaccagacucggaucgaccgccggcucgggcaccaacgucagcucccuaccaagcaccgcccgaacccgcagcuggguagaggaccaaaaccgaaaccuauccccauucaugcgcggagcccacaacaucaguuucguaaccccccccagcucacgcuccagcucacaaggcaccgucagcaccguccccaaagaaguccucgacucauggaccggcgcauucaacacccgccgacaaccccuauucgcccacauccgcagacgcggcgaaucacgcgucuaa

SEQ ID NO: 39612 - RNA, 807 nt, Artificial Sequence
  derived and/or modified sequence opt11 from capsid_protein_VP2__Norovirus__AGE89668
auggccggcgccuucuucgccggccucgccuccgacguccuaggcuccggccucggcucccuuauaaacgcgggcgccggcgccaucaaccaaaaaaucgacuucgaaaacaaccgcaaacuccaacaagcaagcuuccaauucuccucgaacuuacaacaagccuccuuccaacacgacaaagaaaugcuccaagcccaaaucgaagccaccaaaaaacuccaacaagaaaugaugaaagucaaacaagcaaugcuccucgagggcggcuucuccgaaacagacgccgcccgaggcgccaucaacgcccccaugaccaaaguacucgacugguccggcacacgcuacugggcccccgacgcccgcaccaccaccuauaacgcaggcagauucuccaccccacaacccuccggcacacucccaggacgcaucaacccccgcacacccacaccagcgcgcggcuccuccaacacauccucaaacgcaagcaccgccacguccauacacucaaaccaaaccgucuccacccgccucggaucaaccgcaggaucaggcacaaacguguccucacucccauccaccgcccgcacccgauccugggucgaagaccaaaacagaaaccuaagccccuucaugcgcggagcccacaacauaagcuucgucacaccccccagcucacgcucaucuucccaaggcacagucuccacaguaccgaaagaaguccuagacucauggaccggcgccuucaauacccgacgccaaccccucuucgcacacauccgccgccgcggggaaucgcgaguauaa

SEQ ID NO: 39613 - RNA, 807 nt, Artificial Sequence
  derived and/or modified sequence opt11 from capsid_protein_VP2__Norovirus__AGE89671
auggcgggcgcauucuucgccggccucgcgagcgacguccuaggaucaggccugggcucacucauaaacgcgggcgcgggcgcaaucaaccaaaagaucgacuucgagaacaaccgcaagcuacaacaagccagcuuccaauucuccucgaaccugcaacaggcaucauuccaacacgacaaagaaaugcuacaagcgcaaauagaagcaaccaagaaacugcaacaagaaaugaugaaagucaaacaagcgaugcugcucgaaggcggauucucggaaacggacgcggccagaggcgcaaucucggccccgaugacgaaagugcucgacugguccggcacccgcuacugggcgcccgacgcccggaccacgaccuacaacucaggcagauucucaaccccgcaaccaagcgggacccugcccggacgcauaaacccacgcacgccaacacccgcacgcggaagcucauccacgagcucaaacgcgagcaccgccacaagcauacaccugaaccaaaccguauccacacgacugggcucgaccgcgggcucaggcacgaacguaagcucccuaccgagcacagcaagaaccagaagcugggucgaagaccaaaacagaaaccugagcccauucaugcgcggggcccacaacaucagcuuugucacgcccccaagcucacgaucaucaucacaaggcaccguaagcacggucccaaaagagauacuagacucaugggccggcgcauucaacaccagacgccaaccccuauucgcacacauacgcagacgaggagaaucgcgcguauga

SEQ ID NO: 39614 - RNA, 807 nt, Artificial Sequence
  derived and/or modified sequence opt11 from capsid_protein_VP2__Norovirus__AGE89674
auggcgggagcguucuucgccgggcuagcaagcgacguccuuggcucaggacuaggcucacucauaaacgcgggcgcgggcgcgauaaaccagaaaaucgacuucgaaaacaaccgcaagcuccaacaagcgaguuuccaauucagcucgaacuugcaacaagccucauuccagcacgacaaagaaaugcugcaagcgcaaauagaagcgaccaagaaacugcaacaggaaaugaugaaggucaagcaagcgauguuacuagaaggcggguucucggaaacagacgcggcccguggcgcgaucaacgccccaaugacaaaagugcucgacuggucgggcacacgcuacugggcacccgacgcccgaaccacgacauacaacgcaggcagguucucgaccccgcaaccgagcgggacccuacccgggcgcauaaacccacgcacgccuacacccgcgcgcgggagcucaaacacgagcucgaacgcgagcacagccacaagcauucacucgaaccagaccgugagcacgagauugggcucgaccgcgggcucaggaacaaacgugagcucgcucccgagcacagccaggaccaggagcugggucgaggaccagaaccggaaccugagccccuucaugcgcggcgcccacaacauaaguuucguaacacccccguccucccgaucgagcucacaaggaaccgugagcacagucccgaaagaaguacuagacucguggacaggcgcauucaacaccaggcgucagcccuuauucgcgcacauacgcaggcgcggcgaaucacgaguguga

SEQ ID NO: 39615 - RNA, 807 nt, Artificial Sequence
  derived and/or modified sequence opt11 from capsid_protein_VP2__Norovirus__AGE99604
auggccggcgcauucuucgccggccucgcauccgacguccucucauccggacugggcucccucauaaacgccggcgccggcgccaucaaccaaaaaaucgacuucgaaaacaaccgcaaacuccaacaagccagcuuccaauucuccucaaaccuucaacaagccuccuuccaacacgacaaagaaaugcuacaagcccaaaucgaagccaccaaaaaacuacaacaagaacucaugaaagucaaacaaaccauccuccucgaaggcggcuucuccgaaaccgacgcagcccgcggcgccaucaacgcacccaugacaaaagcccucgacugguccggcacacgcuacugggcccccgacgccagaaccaccaccuauaacgccggcagauucuccaccccccaacccuccggcgcucuccccggacgcauaaacccccgaacacccauacccgcccgaggcagccccuccauaagcuccaacgcaucaaccgcaacauccauacacucaaaccaaacagccuccacccgccucggcucaaccgccggcucgggcaccaacgucuccucacucccauccaccgcacggacccgcucaugggucgaagaccaaaaccgcaacuuauccccuuucaugcgcggcgcccacaacaucuccuucgucaccccccccuccucacgcucauccucccaaggcaccgucagcaccguacccaaagacguccuggacucguggacaggcgccuucaacacccgccgccaaccccuauucgcacacauccgacgucgcggcgaaucacgagucuaa

SEQ ID NO: 39616 - RNA, 807 nt, Artificial Sequence
  derived and/or modified sequence opt11 from capsid_protein_VP2__Norovirus__AGE99607
auggccggcccauucuucgccggccucgccuccgacguccuaggcucaggccucggcucacucaucuccgccggcgccggcgccaucaaccaaaaagucgaauucgaaaacaaccgaaaacuccaacaagcaucauuccaauucucaucaaaccuacaacaagcaucauuccaacacgacaaagaaaugcuacaagcccaaauagaagcaacccaaaaacuacaacaagaacucaugaaaguaaaacaagccguccuacucgaaggcggauucuccaccacagacgcagcccgcggcgccaucaacgccccaaugaccaaagcacucgacuggucgggcacacguuacugggcaccagacgccagaaucacgaccuacaacgccggccgauucucaaccccacaaccccucggcgcccuacccggacgcaccaacccccgcguccccgccuccgcccgaucaucccccucaucacucuccaacgcaccaacagccaccagcguauacucaaaccaaaccgcaagcacccgacucggcuccagcgccggaucaggagcaggcgucagcucccuacccuccaccgcccgcacccgcucaugggucgaagaccaaaacaaaaaccuaagccccuucaugaaaggcgcccuaaacaccuccuucgucaccccaccaagcucccgcucgagcaaccaaggaaccgucuccacugucccaaaagaaauccucgacucauggaccggcgccuucaacacccgccgccaaccccuguucgcccacauccgcaaacgaggcgaaucacgaguguaa

SEQ ID NO: 39617 - RNA, 807 nt, Artificial Sequence
  derived and/or modified sequence opt11 from capsid_protein_VP2__Norovirus__AGK36312
auggcgggcgcauucuucgccggacucgcgagcgaugucuugggcucaggacugggcucacuaauaaacgcaggcgcgggcgcaauaaaccagaaaaucgacuucgaaaacaaccgcgagcuccaacaagccagcuuccaauucagcuccaaccuacaacaggcaucguuccagcacgacaaagaaaugcugcaagcacaaauagaagccaccaagaaauuacaacaagaaaugaugaaaguaaaacaagcgaugcuacucgaaggaggcuucucagaaacagacgcggccagaggcgcgaucaacgccccaaugacgaaagugcucgacuggucgggcacgcgcuacugggcgcccgacgcccggaccacaaccuacaacgcgggaagauucucaaccccacaaccaagcgggacccuccccggacgcaucaacccacgcacgcccacaccagcacgcggaagcucaagcgccagcucaaacgcgagcacagccacgagcauauacucaaaccaaaccgugagcacacgccuaggcucgaccgcgggcucaggcacgaacguaagcucgcucccgagcaccgcccgcacccggagcugggucgaagaccaaaacagaaaccugagcccauucaugcgcggagcccacaacaucagcuucguaacacccccguccucacgauccagcucacaaggaacaguaagcacagucccaaaagaaguccuggacucauggacgggcgcauucaauaccagacgccaaccccuguucgcccacauacgcagacguggagaaucacgagucuaa

SEQ ID NO: 39618 - RNA, 807 nt, Artificial Sequence
  derived and/or modified sequence opt11 from capsid_protein_VP2__Norovirus__AGK36315
auggccggcgccuucuucgccggacucgccuccgacguccuaggcucaggccuaggcucccucaucaacgcaggcgccggcgcaaucaaccaaaaagucgaauucgaaaacaaccgcaagcuucaacaagcauccuuccaauucagcuccaaccuacaacaagccuccuuccaacacgacaaagaaaugcuacaagcccaaaucgaagccaccaaaaaacuccaacaagaaaugaugcgcgucaagcaagccaugcuacucgaaggcggauucuccgaaacggacgcagcacgcggcgccaucaacgccccaaugacaaaaacacucgacugguccggaacccgcuacugggcccccgacgccagaacaacuaccuacaacgcaggcagauucucaaccccccaaccauccggcgcccuacccggucgcgcaaaccuccgcgccaccguccccgcacgcggcucaucguccaccuccucaaacuccagcaucgccacauccgucuacuccaaccaaaccaccagcacacgccucggcuccaccgccggauccggcacauccguauccucccucccaagcaccgcccgaacccgcagcuggguagaagaccaaaaccgaaaccuuucuccauucaugcgcggagcccacaacaucuccuucgucaccccccccagcucccgaucauccucacaaggcaccgucuccaccguaccgaaagaaguacuagauucauggaccggcgccuucaacacccgccgccaaccccuauucgcccacauccgcaaacguggcgaaucccgcgucuga

SEQ ID NO: 39619 - RNA, 639 nt, Artificial Sequence
  derived and/or modified sequence opt11 from capsid_protein_VP2__Norovirus__AGM33209
auggcacaagcaaucaucggcgccauagccgccuccaccgccggcucagcccucggagccggcauacaaguaggcggagaagccgcccuacaaucccaacgcuaccaacaaaaccuccaacuccaagaaaacucauucaaacacgaccgagaaaugaucggcuaccaagucgaagccucaaaccaacuccucgccaaaaaccucgccacccgcuacucccuacuccgcgccggaggccucaccuccgccgacgccgcacguuccgucgccggcgcccccgucacacgcaucguagacuggaacggaguccgagucuccgcccccgaauccuccgcaacaacccuccgcuccggcggauucauguccguccccauacccuucgccuccaaacaaaaacaaguccaauccuccggaaucuccaaccccaacuacucacccuccuccaucuccagaaccaccucaugggucgaaucccaaaacuccucccgcuucggcaaccucucccccuaccacgccgaagcccucaacaccguauggcuaaccccccccggcuccaccgccuccucaacccucuccuccgucccccgcggcuacuucaacaccgaccgccucccccucuucgccaacaaccgccgcuaa

SEQ ID NO: 39620 - RNA, 639 nt, Artificial Sequence
  derived and/or modified sequence opt11 from capsid_protein_VP2__Norovirus__AGM33215
auggcccaagccaucaucggcgccaucgcagcaucaaccgccggauccgcccucggcgccggcauccaagucggcggcgaagccgcccuccaaucucaacgcuaccaacaaaaccuccaacuccaagaaaacuccuucaaacacgaccgagaaaugaucggcuaccaagucgaagccucaaaccaacuacucgccaaaaaccucgccacccgcuacucccuccuccgagccggcggccuaaccuccgccgacgccgcacgcagcgucgccggcguccccgucacccgcaucguagacuggaacggcguccgcgucuccgcccccgaauccuccgccaccacacuacgcucaggcggcuucauguccguccccauccccuucgccuccaaacaaaaacaaguccaauccuccggcaucuccaaccccaacuacucccccuccucaaucucccgcaccacaucaugggucgaaucacaaaacuccucccgauucggcaaccuaucccccuaccacgccgaagcccucaacaccgucuggcucaccccacccggcucuaccgccuccuccacccucuccuccgucccccgcggcuacuucaacacagacagacucccccucuucgccaacaaccgccgcuaa

SEQ ID NO: 39621 - RNA, 639 nt, Artificial Sequence
  derived and/or modified sequence opt11 from capsid_protein_VP2__Norovirus__AGM33218
auggcccaagccaucaucggcgccauagcagcauccaccgccggcuccgcacucggcgccggcauacaagucggcggcgaagccgcacuacaaucacaacgcuaccaacaaaaccuacaacuccaagaaaacuccuucaaacacgaccgcgaaaugauaggcuaccaagucgaagccucaaaccaauuacucgccaaaaaccucgcaacacgcuacucccuccuccgcgccggcggccucacaucagccgacgccgcccgcuccguagcuggcgccccagucacccgaaucguagacuggaacggcguccgcgucuccgcccccgaauccuccgccaccacccuacgcuccggcggcuucauguccguccccauccccuucgccucaaaacaaaaacaaguccaauccuccggaaucucuaacccuaacuacucccccuccuccaucucccgcaccaccuccuggguagaaucacaaaacucaucacgcuucggcaaccucuccccauaccacgccgaagcccuaaacaccgucuggcucaccccacccggcuccaccgccucauccacccucuccuccgucccccgcggcuacuucaacacagaccgccucccccuuuucgccaacaaccgccgcuaa

SEQ ID NO: 39622 - RNA, 639 nt, Artificial Sequence
  derived and/or modified sequence opt11 from capsid_protein_VP2__Norovirus__AGM33221
auggcccaagccaucaucggcgccaucgccgcauccacagcaggcuccgcccucggcgccggcauccaagucggcggcgaagccgcacuccaaucccaacgcuaccaacaaaaccuccaacuccaagaaaacuccuucaagcacgaccgcgaaaugaucggcuaccaagucgaagccuccaaccaacuccucgccaaaaaccucgcaacaagauacucccuccuacgagccggcggccuuaccuccgccgacgccgcccgcucugucgccggagcccccgucacacgcaucgucgacuggaacggcguccgagucuccgcacccgaaucauccgccaccacccuacguuccggcggcuucauguccguccccauacccuucgccuccaaacaaaaacaaguccaauccuccggcaucuccaacccaaacuacucccccuccuccaucucacgcaccaccucaugggucgaaucccaaaacucaucccgcuucggcaaccuaucccccuaccacgccgaagcacucaacaccgucuggcucaccccaccaggcucaaccgccucauccacccucucauccguaccccgcggcuacuucaacacagaccgacucccccucuucgccaacaaccgccgcuaa

SEQ ID NO: 39623 - RNA, 639 nt, Artificial Sequence
  derived and/or modified sequence opt11 from capsid_protein_VP2__Norovirus__AGM33224
auggcccaagccaucaucggcgccaucgccgccuccaccgcaggcuccgcccucggcgccggcauccaaguuggcggcgaagccgcccuccaaucccaacgcuaccaacaaaaccuccaacuccaagaaaacucuuucaaacacgaccgcgaaaugaucggcuaccaagucgaagccucaaaccaacuccucgccaaaaaccucgccaccagauacucccuccuccgugccggcggacucaccuccgccgacgccgcccgcucaguagccggcguccccgucacccgcaucgucgacuggaacggcguccgcgucuccgcaccagaauccuccgccaccacccuccgcuccggcggcuucaugucaguccccauccccuucgccucaaaacaaaaacaaguccaauccuccggaaucuccaaccccaacuacucacccucauccaucucccgcaccaccuccugggucgaaucccaaaacuccucccgcuucggaaaccucucccccuaccacgccgaagcccucaacacagucuggcuaacuccacccggcucaaccgcauccuccacccuuucauccguaccccgcggcuauuucaacaccgaccgccuaccccucuucgccaacaaccgccgauaa

SEQ ID NO: 39624 - RNA, 639 nt, Artificial Sequence
  derived and/or modified sequence opt11 from capsid_protein_VP2__Norovirus__AGM33227
auggcccaagccaucaucggagccaucgccgccuccaccgcaggcuccgcccucggcgccggcauccaagucggcggcgaagccgcccuccaaucccaacgcuaccaacaaaaccuccaacuacaagaaaacucuuucaaacacgaccgcgaaaugaucggcuaccaaguagaagccuccaaccaacuccucgccaaaaaccucgccacccgcuacucccuacuucgcgccggcggccucaccucagccgacgccgcccgcuccgucgccggcgcccccgucacccgcauagucgacuggaacggcguccgcgucuccgcccccgaauccuccgccaccacucuacgcuccggcggcuucauguccguccccauccccuucgccuccaaacaaaaacaaguacaauccucaggcauauccaaccccaacuacucccccuccucaaucucccgaaccaccuccugggucgaaucccaaaacuccucccgcuucggcaaccucuccccuuaccacgccgaagcccucaacaccgucuggcucacaccacccggcucaacugccuccuccacccuauccuccgucccccgcggcuacuucaacaccgaucgccucccccucuucgccaacaaccgccgcuaa

SEQ ID NO: 39625 - RNA, 639 nt, Artificial Sequence
  derived and/or modified sequence opt11 from capsid_protein_VP2__Norovirus__AGM33230
auggcccaagccaucaucggcgccaucgccgccuccaccgccggcucagcccucggcgccggcauccaagucggcggagaagccgcccuccaaucccaacgcuaccaacaaaaccuccaacuucaagaaaacucuuucaaacacgaccgcgaaaugaucggcuaccaagucgaagccuccaaccaacuucucgccaaaaaccucgccacccgcuacucccuccuccgcgccggcggccucaccuccgccgacgccgcccgauccgucgccggcguccccgucacacgaaucgucgacuggaacggcguccgcguauccgcccccgaaucauccgccaccacccuccgcucaggcggauucaugucuguacccauccccuucgccuccaaacaaaaacaaguccaauccucaggcaucuccaaccccaacuacucucccuccuccaucucccgcacaaccuccugggucgaaucacaaaacucaucuagauucggcaaccucucccccuaccacgccgaagcccucaacaccgucuggcucaccccacccggcuccaccgcauccucaacccucuccucagucccccgcggcuacuuuaacaccgaccgccucccccuauucgccaacaaccgccgauaa

SEQ ID NO: 39626 - RNA, 639 nt, Artificial Sequence
  derived and/or modified sequence opt11 from capsid_protein_VP2__Norovirus__AGM33233
auggcccaagccaucaucggagccaucgccgccuccaccgccggcuccgcccucggcgccggcauccaagucggcggcgaagccgcccuccaaucacaacgauaccaacaaaaccuccaacuccaagaaaacuccuucaaacacgaccgcgaaaugaucggcuaccaagucgaagccuccaaccaacuccucgccaaaaaccucgccacccgcuacucucuccuccgcgcaggcggacucaccuccgccgacgccgcccgcuccgucgccggcgucccagucacccgcaucgucgacuggaacggaguccgcguauccgcccccgaaucauccgccacaacccuccgcucuggcggcuucauguccgucccaauccccuucgcaucaaaacaaaaacaaauccaauccuccggcaucuccaaccccaacuacucccccucuuccaucucccgcaccaccuccugggucgaaucccaaaacuccucccgcuucggcaaccucucccccuaccacgccgaagcccucaacaccgucuggcucaccccacccggcucaacugccuccucaacccuuucauccgucccccgcggcuacuucaauaccgaccgccuaccccucuucgccaacaaccgccgcuaa

SEQ ID NO: 39627 - RNA, 639 nt, Artificial Sequence
  derived and/or modified sequence opt11 from capsid_protein_VP2__Norovirus__AGM33236
auggcccaagccaucaucggcgccaucgccgccucaacagccggauccgcccucggcgccggaauccaagucggcggcgaagcagcccuccaaucccaacgcuaccaacaaaaccuccaacuccaagaaaacucuuucaaacacgaccgcgaaaugaucggcuaccaagucgaagccuccaaccaacuacuagcaaaaaaccucgccacccgcuacucacuccuccgcgcaggcggacucaccucagccgacgcagcccgaucugucgccggcgcccccguaacccgcaucgucgacuggaacggcguccgcgucuccgcccccgaaucauccgccaccacccuccgauccggcggcuucaugucaguccccauccccuucgccucaaaacaaaaacagguccaauccuccggcauaucaaaccccaacuacucucccuccuccaucucccgaacaaccuccugggucgaaucccaaaauuccucccgauucggaaaccucucccccuaccacgcagaagcccucaacaccgucuggcucaccccccccggcuccaccgccuccuccacccucuccucagucccccgcggcuacuucaacaccgaccgccuaccccucuucgccaacaaccgccgauaa

SEQ ID NO: 39628 - RNA, 639 nt, Artificial Sequence
  derived and/or modified sequence opt11 from capsid_protein_VP2__Norovirus__AGM33239
auggcccaagcaauuaucggcgccauagccgccuccaccgccggcuccgcccucggcgccggcauacaagucggcggcgaagccgcccuccaaucccaacgauaccaacaaaaccuacaacuacaagaaaacuccuucaaacacgaccgcgaaaugaucggcuaccaagucgaagccuccaaccaacuccucgccaaaaaccucgcaacccgcuacucccuacuccgcgccggcggccucaccucugccgacgccgcccgcuccgucgccggcgccccagucacccgaaucgucgacuggaacggaguacgcgucuccgcccccgaaucauccgccaccacccuccgcucaggcggcuucauguccguccccaucccauucgcauccaaacaaaaacaaguacaauccuccggcaucuccaaccccaacuacucacccuccuccaucucccgcaccaccucaugggucgaaucacaaaacucaucccgcuucggcaaccuaucccccuaccacgccgaagcccucaacaccgucuggcucacacccccaggcucaaccgccuccuccacccucuccuccgucccccgcggcuacuucaauaccgaccgacucccccucuucgccaacaaccgccgcuaa

SEQ ID NO: 39629 - RNA, 639 nt, Artificial Sequence
  derived and/or modified sequence opt11 from capsid_protein_VP2__Norovirus__AGM33242
auggcccaagccaucaucggcgccauagccgcaucaaccgcaggcuccgcccucggagccggaauccaagucggaggcgaagccgcccuucaaucacaacgcuaccaacaaaaccuacaacuacaagaaaacuccuucaaacacgaccgcgaaaugaucggcuaccaagucgaagccucaaaccaacuccucgccaaaaaccucgccacccgcuacucccuacuccgagccggcggccuaaccuccgccgacgccgcccgcuccguagccggcgcccccgucacccgcaucguagacuggaacggcguccgcgucuccgcacccgaauccuccgccaccacccuccgcuccggcggcuucauguccguccccauccccuucgcauccaagcaaaaacaaguccaauccuccggcaucuccaaccccaacuacucacccucauccaucucccgcacaacaucaugggucgaaucccaaaacuccucccgcuucggaaaccucucccccuaccacgccgaagcccucaacaccgucuggcuaaccccccccggcuccaccgcauccuccacccuaucauccguaccccgcggauacuucaacaccgaccgccucccccucuucgccaacaaccgccgcuaa

SEQ ID NO: 39630 - RNA, 639 nt, Artificial Sequence
  derived and/or modified sequence opt11 from capsid_protein_VP2__Norovirus__AGM33245
auggcccaagcaaucaucggcgccaucgccgcauccaccgccggcucagcccucggcgccggcauucaagucggcggcgaagccgcccuccaaucccaacgcuaccaacaaaaccuacaacuacaagaaaacuccuucaaacacgaccgugaaaugaucggcuaccaagucgaagccuccaaccaacuacucgccaaaaaccucgccaccagauacucccuccuacgcgccggcggccuaaccuccgccgacgccgcccgcuccgucgccggcguccccgucacccgcauagucgacuggaacggcguccgagucuccgcccccgaauccuccgccaccacccuccgcuccggaggcuucauguccguccccauccccuucgccuccaaacaaaaacaaguccaauccuccggcauaucaaaccccaacuacucccccuccuccaucucccgcaccaccuccuggguagaaucacaaaacucaucacgauucggcaaccucucccccuaccacgccgaagcccucaacaccgucuggcucaccccacccggauccaccgccuccuccacccuauccucaguacccagaggcuacuucaacaccgacagacucccccuauucgcaaacaaccgccgcuaa

SEQ ID NO: 39631 - RNA, 639 nt, Artificial Sequence
  derived and/or modified sequence opt11 from capsid_protein_VP2__Norovirus__AGT17786
auggcccaagccaucaucggcgccaucgccgccuccaccgcaggcucagcccucggcgccggcauccaagucggcggagaagccgcccuccaaucacaacgauaccaacaaaaccuccaacuccaagaaaacuccuucaaacacgaccgagaaaugaucggcuaccaagucgaagccuccaaccaacuccuagccaaaaaccuagccacccgauacucccuacuccgagcaggcggacucaccucugccgacgccgcccgcuccgucgcuggcgcccccgucacccgaaucgucgacuggaacggaguccgcgucucagcccccgaauccuccgccaccacccuccgcuccggcggcuucauguccguccccauacccuucgccucaaaacaaaaacaaguccaauccuccggcaucuccaaccccaacuacucccccuccuccaucucccgcaccaccuccugggucgaaucccaaaacuccucuagauucggaaaccucucccccuaccacgccgaagcccuaaacaccgucuggcucaccccacccggcuccaccgccuccuccacccucucaucagucccccgcggcuacuucaacaccgaucgacucccccucuucgccaacaaccgccgcuaa

SEQ ID NO: 39632 - RNA, 639 nt, Artificial Sequence
  derived and/or modified sequence opt11 from capsid_protein_VP2__Norovirus__AGT17793
auggcccaagccaucaucggagccaucgccgccuccaccgccggcuccgcccucggcgccggcauccaagucggaggcgaagccgcccuacaaucccaacgcuaccaacaaaaccuacaacuccaagaaaacuccuucaaacacgaccgcgaaaugauaggcuaccaagucgaagccagcaaccaacuccucgccaaaaaccucgcaacacgcuacucccuccuccgcgccgguggccucacauccgcagacgccgcccgcuccgucgccggagcccccgucacccgcaucgucgacuggaacggcguccgagucuccgcacccgaauccuccgccaccacccuccgcuccggcggcuucauguccguacccauccccuuugccuccaaacaaaaacaaguccaauccucaggcaucuccaaccccaacuacucccccuccuccaucucccgcaccaccuccugggucgaaucccaaaacuccucucgcuucggcaaccucucccccuaccacgcagaagcccuaaacaccgucuggcucaccccacccggcuccaccgccuccuccacccucuccucagucccccgcggcuacuucaacaccgaccgccuuccacucuucgcaaacaaccgacgcuaa

SEQ ID NO: 39633 - RNA, 807 nt, Artificial Sequence
  derived and/or modified sequence opt11 from capsid_protein_VP2__Norovirus__AGT17796
auggcaggcgccuucuucgccggccucgcauccgacguccucggcuccggccuaggaucccucaucaacgccggcgccggcgcaaucaaccaaaaagucgaauucgaaaacaaccgcaaacuccaacaagccuccuuccaauucagcuccaaccuccaacaagccuccuuucaacacgacaucgaaaugcuccaagcccaaauagaagcaaccaaaaaacuacaacaagaaaugaugcgagccaaacaagccaugcugcucgaaggcggauucucagaaacagacgccgccagaggagcgaucaacgcccccaugaccaaaacacucgacuggucaggcacacgcuacugggcccccgacgccagaaccacaaccuacaacgcaggccgcuuuucgaccccacaacccuccggagcccaacccggacgcgcaaaucuacgcgccacaguccccgcccgcggcuccucauccaccuccucaaacuccuccauagccaccuccguauacucaaaccaaaccaccuccacccgccucggcucaacagccggcuccggcacauccgucuccucccuccccuccacggcacgcacccgauccuggguagaagaccaaaacagaaaccucucccccuucaugcgcggcgcccacaacaucuccuucgucaccccccccuccucucgcuccuccucccaaggcaccguaucaacaguccccaaagaaguccucgacucauggaccggcgccuucaacacccgacgccaaccccuguucgcacacauccgcaaacgaggcgaaucgcgcgucuaa

SEQ ID NO: 39634 - RNA, 807 nt, Artificial Sequence
  derived and/or modified sequence opt11 from capsid_protein_VP2__Norovirus__AGT17799
auggcaggcgcguucuucgcagggcuagcgagcgauguccuaggaucgggacugggcucacuaauaaaugcaggcgcaggcgcaauaaaccaaaaagucgaguucgagaacaaccgcaagcuccaacaagacagcuuccaauucaguucaaaccuccaacaggccuccuuccagcacgacaaagagaugcugcaagcacaaauagaagcgaccaagaaacugcaacaggaaaugaugagagucaagcaagcaauguugcucgaaggcggauucucggaaacggacgcggccaggggcgcaaucaacgccccgaugacgaaagugcucgacuggucgggcacgagauacugggcgccaggggccaggacaacgacauacaacgcgggcuacuucucaaccccacaacacagcggagccuugccagggcgcgcgaaccuacgcgcggucgugcccgcgcgcgggagcucacgcguaagcuccaacucgagcacagccacgagcguauacucaaaccagaccgcgagcacgcgauugggcucgaccgcaggcucuggcacgagugugagcucacuaccaagcaccgccagaaccaggagcugggucgaggaccaaaacaggaacuugagcccauucaugcgcggagcccacaacaucagcuucgucacgcccccauccucgcgcucgagcucacaaggcaccgugagcaccgucccgaaagaggucuugaacucgcaagcgggcguauucaacaccaggcgccagccccuguucgcgcacauacgcaggcgcggggaaucgcgagcguga

SEQ ID NO: 39635 - RNA, 639 nt, Artificial Sequence
  derived and/or modified sequence opt11 from capsid_protein_VP2__Norovirus__AGT17804
auggcccaagccaucaucggcgccaucgccgccuccaccgccggauccgcccucggcgccggaauccaagucggcggagaagccgcccuccaaucccaacgcuaccaacaaaaccuccaacuccaagaaaacuccuucaaacacgaccgcgaaaugaucggcuaccaagucgaagccuccaaccaacuacuagccaaaaaccucgccacccgcuacucucuccuacgagccggaggccuaaccucagcugacgcagcccgcucugucgcaggagcacccgucacccgcaucgucgacuggaacggcguccgcgucuccgcccccgaauccuccgccaccacacuccgcucaggcggcuucaugucuguacccauacccuucgccucaaaacaaaaacaaguccaauccucaggcauauccaaccccaacuacuccccauccuccaucucccgcaccacauccugggucgaaucccaaaacuccucccgcuucggcaaccucucccccuaccacgccgaagcccucaacaccgucuggcucaccccucccggcuccacugccuccucaacacucucauccgucccccgcggcuacuucaacaccgaccgccucccccucuucgccaacaaccgacgcuaa

SEQ ID NO: 39636 - RNA, 639 nt, Artificial Sequence
  derived and/or modified sequence opt11 from capsid_protein_VP2__Norovirus__AGT17807
auggcccaagccaucaucggagccaucgccgccuccaccgccggcucagcccuuggcgccggcauccaagucggcggcgaagccgcccuccaaucacaacgcuaccaacaaaaccuccaacuccaagaaaacuccuucaaacacgaccgcgaaaugaucggcuaccaagucgaagccuccaaccaacuccucgccaaaaaccucgccacccgcuacucccuacuccgagccggcggccucaccuccgccgacgccgcacgcucagucgccggcgccccagucacacgcaucgucgacuggaacggcguccgagucuccgcacccgaauccuccgccacaacccuucgcuccggcggcuucauguccguccccauccccuucgccuccaaacaaaaacaaguccaauccuccggcaucuccaaccccaacuacucccccuccuccaucucccguaccaccuccugggucgaaucccaaaacuccucccgcuucggcaaccucucccccuaccacgccgaagcccucaacaccgucuggcucaccccacccggcuccacugccuccuccacccucuccuccgucccccgaggcuacuucaacaccgacagacucccccucuucgccaacaaccgacgauaa

SEQ ID NO: 39637 - RNA, 639 nt, Artificial Sequence
  derived and/or modified sequence opt11 from capsid_protein_VP2__Norovirus__AGT17810
auggcccaagccaucaucggcgccaucgccgcaucaaccgccggcuccgcccucggcgccggaauccaagucggcggcgaagccgcccuccaaucccaacgcuaccaacaaaaccuccaacuacaagaaaacuccuucaaacacgaccgcgaaaugaucggcuaccaagucgaagccuccaaccaacuccucgccaaaaaccucgccacccgcuacucucuccuccgcgcaggcggccucaccuccgccgacgcagcccgaucugucgcaggagcacccgucacacguaucgucgacuggaacggcguccgcgucucagcaccugaauccuccgccaccacccuccgcuccggcggcuucauguccguaccaauccccuucgccucaaaacaaaaacaaguccaaucauccggcaucuccaaccccaacuacucacccuccuccaucucacgcaccaccuccugggucgaaucucaaaacucaucccgauucggcaaccuaucccccuaccacgccgaagcacucaacacagucuggcuaaccccacccggcuccaccgccucauccacccucuccuccgucccccgcggcuacuucaacacagaccgacucccccucuucgccaacaaccgacgcuaa

SEQ ID NO: 39638 - RNA, 807 nt, Artificial Sequence
  derived and/or modified sequence opt11 from capsid_protein_VP2__Norovirus__AGT17814
auggccggcgcauucuucgccggacucgcaagcgacguccugggcucaggccugggcucacucauaaacgcaggcgccggcgccaucaaccaaaaagucgaauucgaaaacaaccgcaaacuccaacaagcaucauuccaauucagcucgaaccuccaacaagccucauuccaacacgacaaagaaaugcugcaaucacaaaucgacgccaccaaaaaacuccaacaagaaaugaugcgagucaaacaagccaugcuacucgaaggaggcuucuccgaaaccgacgcagccagaggcgcgaucaacgcccccaugaccaaaguacucgacuggucaggcacccgcuacugggcacccgacgcaagaaccacaaccuacaacgccggccgcuucucaaccccccaaccaagcggagccccacccggccgcgccaaccuccgcgccgccguacccgcccgaggaagcucaagcaccagcucaaacucaagcaucgccacaagcauguacucaaaccaaaccacaagcacacgccucggcuccaccgcaggaucaggcacgagcgucagcucacucccaagcuccgcaagaaccagaagcugggucgaagaccaaaaccgaaaccuaagccccuucaugcgcggagcccacaacaucagcuucgucacccccccaagcucacgcucauccucacaaggcaccguauccacagucccaaaagaaguccuagacucauggacaggcgcauucaacacccgccgccaaccccuauucgcccacauccgacgacgcggagaaucacgcgucuaa

SEQ ID NO: 39639 - RNA, 807 nt, Artificial Sequence
  derived and/or modified sequence opt11 from capsid_protein_VP2__Norovirus__AGT17820
auggcaggcgcguucuuugccgggcucgcgagcgacgucuuaggcucgggacugggcucgcucauaaacgcgggcgcgggcgcgauaaaucaaaaggucgaguucgagaacaaucgcaagcuccagcaagccagcuuucaauuuuccucaaaccuacaacaggcaucguuccagcacgacaaagagaugcugcaagcgcaaauagaagcgaccaagaaacugcaacaggaaaugaugcgggccaagcaagcgaugcugcuugaaggcggguucucagaaacagacgcggcccgaggcgcgaucaaugccccgaugacaaaaacgcucgauuggucaggcacgcgcuacugggcgcccgaugcccggaccacaaccuacagcgcaggcagauucucgacaccgcaaccaagcggggccuugcccgggcgcgcgaacuuacgcgcgaccgugcccgcgcgcgggagcucaagcacgagcucgaacucaagcauagccacgagcguguacucgaaccagacaacgagcacgcgcuugggaucgaccgcgggcucaggaacgagcgugagcucgcucccgagcacggccaggaccaggagcugggucgaggaccagaacagaaaccugagcccauucaugcgcggagcccauaacaucagcuuuguuacgccgcccagcucacgaucgagcucgcaagggacagucagcacgguacccaaagaggucuuggacucauggacgggagcguucaauaccagacgccagcccuuguucgcgcacauacgcaagcgaggggaaucgcgcguguga

SEQ ID NO: 39640 - RNA, 807 nt, Artificial Sequence
  derived and/or modified sequence opt11 from capsid_protein_VP2__Norovirus__AGT17824
auggcgggcgcguucuucgccgggcucgcgagcgauguccuaggcucaggccuaggcucgcuuauaaacgcgggcgcgggcgccauaaaccaaaaggucgaguucgagaacaaccgaaaacuccaacaagacagcuuccaauucagcucgaaccuacaacaggccucauuccagcacgacaaagagaugcugcaagcgcaaauagaagccaccaagaaacuacaacaggaaaugaugagggucaagcaagcaauguugcucgagggcggauucucagaaacggacgcggcaagaggagcgauaaacgcaccaaugacaaaagugcucgauuggucaggcacacgcuacugggcgcccgacgcccgaaccacgaccuacaacgcgggucacuucucgaccccacaacacagcggcgccuugcccgggcgcgcgaaccugcgagcgaccguacccgcgcgcgggagcucacgcgcaagcucgaacucgagcacagccacaagcguguacucaaaccagaccacgagcacacgcuuaggcucaaccgccggcucgggcacaagcguaagcucacucccgagcacagccaggaccaggagcugggucgaggaccagaacaggaaccugagcccguucaugcgcggcgcccacaacaucagcuucgucacgcccccgagcucaagaucaagcucgcaagggaccgugagcacgguaccgaaagagguccuaaacucccgcacgggcgcguucaacaccaggcgccagccccuguucgcgcacauacgcaggcaaggagaaucgcgagcguga

SEQ ID NO: 39641 - RNA, 639 nt, Artificial Sequence
  derived and/or modified sequence opt11 from capsid_protein_VP2__Norovirus__AGT17827
auggcccaagccauuaucggagccaucgccgcauccaccgcaggcuccgcacucggagccggcauccaagucggaggcgaagcagcccuccaaucccaacgcuaccaacaaaaccuccaacuccaagaaaacucauucaaacacgaccgcgaaaugaucggcuaccaagucgaagccuccaaccaacuccuagccaaaaaucuagccacccgcuacucucuccuccgcgccggcggccuaacauccgccgacgccgcccgcuccgucgccggagcccccgucacccgcaucgucgacuggaacggcguccgcgucuccgcacccgaauccuccgccacaacccuccgcuccggcggcuucauguccguccccauccccuucgccucaaaacaaaaacaaguccaaucuuccggcaucucaaaccccaacuacucccccuccuccaucucccgcaccacauccugggucgaaucccaaaacuccucccgcuucggcaaccuaucccccuaccacgccgaagcccucaacaccgucuggcucaccccacccggauccaccgcauccuccacccucuccuccgucccccgcggauacuucaacaccgaccgacucccccucuucgccaacaaccgccgauaa

SEQ ID NO: 39642 - RNA, 807 nt, Artificial Sequence
  derived and/or modified sequence opt11 from capsid_protein_VP2__Norovirus__AGT17831
auggccggagcaaucaucgccggccucgccuccgacguccuuuccucaggccucggcucacucauaaacgccggcgccggcguuaucaaccaaaaagucgacuucgaaaacaacaaacaacuccaacaaaacucauuccaauucagcucaaaccuccaacaagccucauuccaacacgacaaagaaaugcuccaagcacaaauagaagccaccaaaaaacuacaacaagaaaugaugggcaucaaacaagccguccuccucaaaggcggauucuccgaaaccgacgccgcccgcggagccgucaacgccccaaugacuaaaguacuagacuggucaggcacccgauacugggcccccaacgcaucaaccaccaccuacaacgccggccgauucucaaccccccaacccuccggagcacuacccggccgaaccaaccugcgaacagcagcccccgcacgcggcucccccuccaucagcucaaacgccucaaccgccacauccgucuacucaaaccaaaccgucucaacccgacucggaaccuccgccggcucaggaacauccguaagcucccucccuagcaccgccagaacccgcuccuggguagaagaccaaaaccgaaaccucuccccauucaugcgaggcgcccacaacaucuccuucgucacccccccauccucccgcucauccucccaaggcaccgucuccaccguccccaaagaaguccuagacuccuggaccggagccuucaacacacgccgacagccccucuucgcccacauacgcaaacgcggcgaaucccgaguauaa

SEQ ID NO: 39643 - RNA, 639 nt, Artificial Sequence
  derived and/or modified sequence opt11 from capsid_protein_VP2__Norovirus__AGT17837
auggcccaagccaucaucggcgccaucgccgccuccacagccggauccgcccucggcgccggcauccaagucggcggcgaagccgcccuccaaucccaacgauaccaacaaaaccuccaacuccaagaaaacucauucaaacacgaccgcgaaaugaucggcuaccaagucgaagccuccaaccaacuccucgcaaaaaaccucgccacccgcuacucccuacuccgcgccggaggccucaccuccgcagacgccgcccgaucagucgcaggagcccccguaacacgcauagucgacuggaacggcguccgagucuccgcccccgaauccuccgccaccacacuccgcuccggcggcuucauguccguccccauccccuucgccuccaaacaaaaacaaguccaauccucaggaaucuccaaccccaacuacucccccucauccaucucacgcaccacauccuggguagaaucccaaaacucauccagauucggcaaccucucccccuaccacgccgaagcccucaacacagucuggcucaccccccccggauccaccgccuccucaacccucuccuccgucccccgcggcuacuucaacaccgaccgccucccccuauucgccaacaaccgccgauaa

SEQ ID NO: 39644 - RNA, 807 nt, Artificial Sequence
  derived and/or modified sequence opt11 from capsid_protein_VP2__Norovirus__AGT17843
auggcaggcgcauucuucgcuggacuagccucagacguccucggcucaggccucggcucacucaucaacgccggcgccggcgccaucaaccaaaaagucgaauucgaaaacaaccgcaaacuccagcaagacagcuuccaauucuccucaaaccuacaacaagccucauuccaacacgacaaagaaaugcuacaagcacaaaucgaagccaccaaaaaacuccaacaagaaaugaugagagucaaacaagccaugcuccucgaaggcggcuucuccgaaaccgacgcggcacgaggagccauaaacgcacccaugacaaaaguccucgacuggaauggaacccgcuacugggcccccggcgcccgcaccaccacauacaacgccggacacuucuccaccccccaacacucaggcgcccuccccggccgcgccaaccuccgcgccgccguccccgcccgcggcucaucccgagccucaucaaacucauccaccgccacuagcgucuacucuaaccaaaccacauccacacgccucggauccaccgccggcuccggcaccuccgucuccucccuacccuccaccgcccgaacccgcuccugggucgaagaccaaaaccgcaaccucagccccuucaugcgcggcgcccacaacaucuccuucgucaccccccccuccucccgcucauccucccaaggcaccgucagcaccguccccaaagaaguccucaacucccaaaccggcgccuucaacacccgccgccaaccccucuucgcccacauccgccgccgcggcgaaucccgagccuaa

SEQ ID NO: 39645 - RNA, 807 nt, Artificial Sequence
  derived and/or modified sequence opt11 from capsid_protein_VP2__Norovirus__AGX85887
auggcgggcgcguucuucgccggacuagcgagcgacguccucagcucaggccuaggcucccuaauaaacgcaggcgcgggcgcgaucaaccaaacagucgaguucgagaacaaccgcaaacuccagcaagcgagcuuccaauucagcucgaaccugcaacaagcaucguuccagcacgacaaagagaugcuacaaucgcaaauagacgcaaccaagaaauugcaacaggaaaugaugagagucaaacaagcaaugcuacuagagggaggguucucggaaacagacgcagccagaggagcaaucaacgcccccaugacgaaagugcucgacuggucgggcacgcgcuacugggcgcccgacgcaagaaccacgaccuacaacgcaggcagauucucaacaccgcaaucaagcggggccccgcccgggcgcgcgaaccugcgagcggcagugcccgcgcaagggagcucaagcacaagcucaaacucgagcauagccacgagcauguacuccaaccagaccacgagcacgcgccugggaucaaccgcaggcucgggcacgagcguaagcucccucccgagcucagccaggaccagaagcugggucgaggaccagaacaggaaccuauccccguucaugcgcggggcacacaacaucagcuucgucacgcccccaagcucgcgaucgagcucacaagggaccguaagcaccgucccgaaagagguccuggacucauggacaggcgcguucaacaccaggcgccaaccccuguucgcacacauacgccggcgcggggaaucgcgcguauga

SEQ ID NO: 39646 - RNA, 807 nt, Artificial Sequence
  derived and/or modified sequence opt11 from capsid_protein_VP2__Norovirus__AGX85893
auggccggcgcauucuucgccggccucgccuccgacguccucggcuccggccuuggcucccucaucaacgcaggcgcaggcgccauaaaccaaaaagucgaauucgaaaacaaccgcaaacuacaacaagacucauuccaauucuccuccaaccuucaacaagccuccuuccaacacgacaaagaaaugcuccaagcacaaaucgaagccacaaaaaaacuccaacaagaaaugaugagagucaaacaagccaugcugcucgaaggcggcuucucagaaacugacgccgcccgcggagccaucaacgcccccaugaccaaaguccucgacugguccggcacccgcuacugggcccccggcgccaggaccaccaccuacaacgccggcuacuucuccaccccacaacacuccggagcccuccccggccgagccaaccuccgcgccgccguacccgcacgcggcuccucacgcgucucauccaacuccucaaccgcaacauccgucuacuccaaccaaaccgcauccacccgccucggcuccaccgccggcuccggcacaagcguaucuucccucccauccaccgcccgaacccgcucaugggucgaagaccaaaaccgcaaccucucccccuucaugcgcggcgcccacaacaucuccuucguaaccccacccuccucaagauccuccucacaaggcaccgucuccaccgucccaaaagaaguccuaaacucacaaacgggcgucuucaacacccgacgccaaccccuauucgcccacauccgccgccgaggcgaaucccgcgccuaa

SEQ ID NO: 39647 - RNA, 807 nt, Artificial Sequence
  derived and/or modified sequence opt11 from capsid_protein_VP2__Norovirus__AGX85896
auggcaggcgcguucuucgcaggacucgccagcgacguccuaggcucaggccugggcucacuaauaaacgccggcgcaggcgcaaucaaccaaaaagucgaauucgaaaacaaccgcaaacuccaacaagacagcuuccaauucagcucgaaccuacaacaagccucauuccagcacgacaaagaaaugcugcaagcacaaauagaagcaaccaaaaaacuacaacaagaaaugaugaggguaaaacaagcaaugcuacucgaaggcggauucucagaaacggacgcagccagaggcgcaauaaacgccccaaugacgaaaguacucgacuggucaggcacacgauacugggcgcccggagccagaaccacgaccuacaacgcaggcuacuucucgaccccacaacacuccggggcccuacccggccgcgcaaaccugcgagcagccguacccgcacgcgggagcucccgaguaagcuccaacucaagcacagccacaagcguauacucaaaccaaaccgcaagcacacgccucggcucaaccgcgggcucaggcacgagcgucagcucgcuaccaagcaccgccagaacaaggagcugggucgaagaccagaacagaaaccugagcccauucaugcgaggagcccacaacauaagcuucgucacaccccccagcucacgcuccagcucacaaggcaccgugagcacaguaccaaaagaaguccuaaacucacaaacaggcgcauucaacaccagacgccaaccccuauucgcacacauacgccgacgcggagaaucacgcgcauaa

SEQ ID NO: 39648 - RNA, 807 nt, Artificial Sequence
  derived and/or modified sequence opt11 from capsid_protein_VP2__Norovirus__AGX85905
auggccggcgcauucuucgccggccuagccucagacguccucuccuccggccucggcucccucaucaacgccggcgcaggcgcaaucaaccaacgcaucgacuucgaaaacaaccgcaaacuccaacaagccuccuuccaauucuccuccaaccuacaacaagccuccuuccaacacgacaaagaaaugcuccaagcccaaauagaagcaaccaagaaacuacaacaagaacuaaugaaagucaaacaagccaugcuacuagaaggcggcuucuccgaaaccgacgccgcccgcggcgccaucaacgcccccaugaccaaagcccucgacugguccggaacccgcuacugggcccccgacgcccgaaccacuaccuacaacgccggaagauucuccacaccccaaccauccggcgcccuccccggccgcaucaacccacgcacccccauccccgcccgcggcagccccuccaucuccucaaacgucucaaccgccaacuccauccacuccaaccaaaccgcaucaacccgacucggcuccaccgcaggcuccggcaccgacgucucaucacucccaucuaccgcccgcacccgcuccugggucgaagaccaaaaccgcaaccucuccccauucaugcgaggcgcccacaacaucuccuucgucaccccacccucaucccgcucauccucccaaggcaccgucuccaccguccccaaagacguccuagacucauggaccggcgcauucaacacccgccgccaaccccuauucgcacacauccgccgccgcggcgaaucccgcgucuaa

SEQ ID NO: 39649 - RNA, 807 nt, Artificial Sequence
  derived and/or modified sequence opt11 from capsid_protein_VP2__Norovirus__AGX85914
auggcgggcgcguucuucgccgggcucgcgagcgacguccugggaucgggccuaggcucacucauaaacgcaggcgcaggagcgaucaaccaaaaggucgaguucgagaacaaucgaaagcuccagcaagacaguuuccaauucagcuccaaccugcaacaggccucauuccagcacgacaaagagaugcugcaagcacaaauagaagcgaccaagaaacugcaacaggagaugaugagagucaaacaagcgaugcugcucgagggcggguucucggaaacggacgcggcaaggggcgcaaucaacgcccccaugacgaaaguacucgacuggucgggcacacgcuacugggcccccggagccagaaccacgaccuacaacgcaggcuacuucucaaccccgcaacacagcggggcauugcccgggcgcgcgaaccugcgugcaguaguaccagcacgagggagcucgcgcgugagcucgaacuccagcacagccacgagcguguacucgaaccagacagcgagcacgcgcuugggcucgaccgcaggcucaggcacgagcguaagcucgcucccaagcacggccagaaccagaagcugggucgaggaccagaacaggaaccugagcccguucaugcgcggagcccacaacaucagcuucgucacgcccccaagcucgcgcucaagcucgcaaggaaccgugaguacggucccgaaagagguccugaacucacaaacaggcguguucaacacaaggcgccagcccuuauucgcacacauaagaaggcgaggagaaagccgcgcauga

SEQ ID NO: 39650 - RNA, 807 nt, Artificial Sequence
  derived and/or modified sequence opt11 from capsid_protein_VP2__Norovirus__AGX85917
auggcaggcgccuucuucgccggccucgccuccgacguccucagcucgggccucggcucacuaauaaacgccggcgccggcgccaucaaccaaacagucgaauucgaaaacaaucgcaaacuacaacaagccuccuuccaauucuccucaaaccuccaacaagccuccuuccaacacgacaaagaaaugcuccaaucccaaaucgacgccaccaaaaaacuucaacaagaaaugaugcgagucaaacaagccaugcuccuagaaggcggcuucuccgaaacagacgccgcccgaggcgccaucaacgcacccaugaccaaaguccucgacuggucaggcacacgcuacugggcacccgacgcccggacaaccaccuacaacgcaggccgauucucaaccccccaauccagcggcgccccacccggccgcgccaaccuacgcgccgccguacccgcccaaggauccuccuccaccuccucaaacucauccaucgcaacaagcauguacuccaaccaaaccaccuccacccgccuaggcuccacagccggcuccggcacauccgucuccucccuccccuccuccgcccgaacacgcuccugggucgaagaccaaaaccgcaaccucagcccauucaugcgaggcgcccacaacauauccuucguaaccccccccagcucacgauccuccucgcaaggaaccgucuccaccguccccaaagaaguccuagacuccuggaccggcgccuucaacacccgccgccaaccccucuucgcccacauacgccgccgcggcgaaucccgcgucuaa

SEQ ID NO: 39651 - RNA, 807 nt, Artificial Sequence
  derived and/or modified sequence opt11 from capsid_protein_VP2__Norovirus__AGX85923
auggcaggcgcgauaauagccggacucgcgagugacgucuugagcucaggccuaggcucacucauaaacgcaggcgcaggaguaaucaaccaaaaaguagacuucgagaacaacaaacaacuccagcaaaacagcuuccaauucagcucgaaccuacaacaagccucguuccaacacgacaaagagaugcugcaagcgcaaauagaagcaaccaagaaacugcaacaggaaaugaugggaaucaagcaagccguccuacucaagggcggauucucagaaacggacgcagccagaggugcaguaaacgccccgaugacaaaaguacucgacuggucaggcacacgcuacugggcacccaacgccucgaccaccacauacaacgcaggccgguucucaaccccgcaaccaagcggggcccuacccggacgcacgaaccuccgaacagccgcgcccgcgcgcggaagcccgagcauaagcucgaacgccagcacagccacgagcguauacucaaaccagacaguaagcacgcgccugggcaccagcgcaggaucaggcacaagcgucuccucgcucccgagcacggccagaaccagaagcugggucgaggaccagaacagaaaccugagcccauucaugcgcggggcccacaacaucagcuucgucacgcccccaagcucacgcucaagcucccaagggaccguaagcacggucccaaaagaggucuuagacucauggacaggcgcauucaacaccaggcgccagccccuauuugcacacauacgcaaacgaggagaaucgcgcguauga

SEQ ID NO: 39652 - RNA, 807 nt, Artificial Sequence
  derived and/or modified sequence opt11 from capsid_protein_VP2__Norovirus__AGX85926
auggcaggcgccaucauagccggacucgcaagcgacguccucagcucaggccuaggcucacucauaaacgccggcgcaggcgccauaaaccaaaccaucgacuucgaaaacaaccgcaaacuccaacaagcaagcuuccaauucagcucaaaccuacaacaagcaucauuccaacacgacaaagaaaugcuacaagcacaaaucgaagcaaccaaaaaacuacaacaagaaaugaugagagucaaacaagccaugcuccucgaaggcggauucuccgaaacagacgcagccagaggagccaucaacgccccaaugacaaaaacccucgacuggucaggcacccgcuacugggcacccgacgccagaacaacaaccuacaacgcgggcagguucuccaccccacaacccagcggggccccacccggacgcgcaaaccuacgcgcaaccacacccgcgcgcggaagcuccagcaccagcuccaacuccagcauagccacauccguauacucaaaccaaaccacaagcacgcgccucggcucaaccgcaggcuccggcaccagcgucuccucccucccaagcacagcccggacccgaucaugggucgaagaccaaaaccggaaccuaagcccauucaugcgcggcgcccacaacauaagcuucgucacucccccaagcucacgcuccagcucccaaggaaccguaagcacagucccgaaagaaguccucgacucguggacaggcgcauucaacaccagacgccagccccuauucgcacacauacgcacaagaggggaaucacgaguauaa

SEQ ID NO: 39653 - RNA, 807 nt, Artificial Sequence
  derived and/or modified sequence opt11 from capsid_protein_VP2__Norovirus__AGX85932
auggccggcgcguucuucgcagggcucgcgagcgauguacugggaucaggccugggaucgcucauaaacgcgggcgcgggcgcgaucaaucaaaaagucgaguucgagaacaaucgcaagcuccagcaagauagcuuccaauucagcucaaaccuacaacaggccucguuccagcacgacaaagagaugcugcaagcgcaaaucgaagcaaccaagaaacugcaacaggaaaugaugagggucaagcaagcgaugcuacucgagggcggguucucggaaacggacgcggccaggggcgcgaucaaugccccgaugaccaaagugcucgacuggucgggcacgcgcuacugggcgcccggggccaggaccacgaccuacaacgcgggauauuucucgacaccgcaacacagcggggcccugcccggacgcgcgaaccuacgcgcggucgugcccgcacgagggaguucgcgcgugagcucgaacucuagcacggccacaagcguguacucaaaccagaccgcgagcacgcgcuuaggcucaaccgcgggcucgggaacgagcguaagcucacuaccgagcacggcccgaaccagaagcuggguagaagaccagaaccggaaccugagcccauucaugcgcggggcacacaacaucagcuucgucacacccccaagcucgcgcucaagcucgcaagggaccguaagcacggucccgaaagaggucuugaacucgcaaacgggcguauucaacaccagacgccaacccuuauucgcgcacauacgcaggcgcggggaaucacgagcguga

SEQ ID NO: 39654 - RNA, 807 nt, Artificial Sequence
  derived and/or modified sequence opt11 from capsid_protein_VP2__Norovirus__AGX85935
auggccggagcauucuucgccggacucgccagcgacgucuuaggcuccggccuaggaucccuaauaaacgcaggcgcaggcgcgaucaaccaaaaagucgaauucgaaaauaaccgcaaacuccaacaagacagcuuccaauucuccucaaaccugcaacaagccucauuccaacacgacaaagaaaugcuccaagcacaaaucgaagcgaccaaaaaacuacaacaagaaaugaugagaguaaaacaagccaugcuccucgaaggcggauucucagaaacagacgcggccagaggcgccaucaacgccccgaugacaaaaguacuagacuggucaggaacccgcuacugggcgccaggagccaggaccacgaccuacaacgcaggauacuucucaacaccgcaacacagcggagcccuaccaggacgcgcgaaccugcgagccgucguacccgcacgcggaagcucacgcguaagcucaaacuccagcacagccacaagcguauacucaaaccaaaccgcauccacgcgccugggcucgacagcaggcucgggcacaagcgugagcucgcucccaagcacagccaggaccagaagcugggucgaggaccaaaacagaaaccuaagcccauucaugcgcggagcccacaacauauccuucgucacaccccccagcucacgcucgagcucacaagggaccgucuccacgguccccaaagaaguccuaaacucacaaacgggcgucuucaacaccagacgccaaccccuauucgcacacauacgccgacgcggcgaaucacgcgcauaa

SEQ ID NO: 39655 - RNA, 780 nt, Artificial Sequence
  derived and/or modified sequence opt11 from capsid_protein_VP2__Norovirus__AHI59155
auggccuccgcauuccucgccggccuagcaggcgacgucauuacaaacggagucggcucccucaucaacgccggcgccaacgccgucaaccaaaaagucgaauacgacuucaacaaacaacuccaaauggcuuccuucaaacacgacaaagaaaugcuccaaucccaaguccucgccaccaaacaacuccaacaagaaaugaugaacauccgccagggcguacucaccgccggcggcuucucacccgccgacgccgcccgaggagccgucaacgcacccaugaccaaaauccuagacuggaacggcacccgcuacugggcacccaacucaaugaaaaccaccuccuauuccggacaauucuccuccucacccguccacaaaucacccgcacccucccaacacacagcucuccccaaaucacgacuacaaaacgacuucgccuccgucuacucauuccccuccuccgucuccucucaaucaacccacuccaccgcccucucagccggcaccggcucauccagauccaucuccccauccaccgccacccccacacucucccgaaccuccgacuggguccgcggccaaaacgaacgccucucacccuucauggacggcgcacuccaaaccgccuucgucaccccacccuccuccaaagccucaucaaacggcacagucuccaccguccccaaagccguccucgacucuuggacccccauguucaacacacaccgccaaccccucuucgcccacccccgacgccgcggagaaucacaagucuaa

SEQ ID NO: 39656 - RNA, 807 nt, Artificial Sequence
  derived and/or modified sequence opt11 from capsid_protein_VP2__Norovirus__AHI59158
auggcgggcgcauucuuugccgggcucgcauccgacgucuugggcucgggcuugggcucacuaauaaacgccggcgcgggcgcgauaaaccaaaaggucgaguucgaaaacaaccgcaagcuccagcaagcgagcuuucaauucagcucgaacuugcaacaagccucguuccaacacgacaaagaaaugcuacaagcacaaauagaagcaaccaagaaacugcaacaggaaaugaugcgagucaaacaagcaaugcugcucgagggcggguucucggaaacggacgcggccagaggcgcgaucaaugccccaaugacgaaaacgcucgacuggucaggcacgcgcuacugggcgcccgacgccaggaccacgaccuacaacgcgggcagguucucaacgccccaaccaagcggggcccugcccggacgcgcaaacuugcgcgcaaccguacccgcgcgcgggagcucgaacaccaguucaagcucgaguauagcaacgagcguguacucgaaccagacaacgagcacgcgccuggguucgaccgcaggcucgggcacgagugugagcucgcuaccgaguacagccaggaccaggagcugggucgaggaccagaacaggaaccugagcccguucaugcgcggggcccacaacaucagcuucgucacgcccccgagcucacgaucgagcucgcaagggaccgugagcacagucccgaaagaagucuuagacucguggacaggagcguucaacaccaggcgccagccccuguucgcgcacauacgcaagcgaggggaaucgcgcguauga

SEQ ID NO: 39657 - RNA, 780 nt, Artificial Sequence
  derived and/or modified sequence opt11 from capsid_protein_VP2__Norovirus__AHI59160
auggccggagccuucgucgccggccucgccggugacguccuaucaaacggccucuccucacucaucaaugcaggcgcaaacgccaucaaccaacgcgccgaauuugacuucaaccaaaaacuccaacagaacuccuucaaccacgacaaagaaaugcuccaagcccaaauccaagcaaccaaacaacuccaagccgacaugauggcaauaaaacaaggcguccucacagccggaggauucucccccgccgacgccgcccgaggcgccgucaacgcacccaugacucaagcccucgacuggaacggcacccgcuacugggcccccggcuccaugcgcacgaccucauacuccggaaaauucaccucaaccgccccaguccgccaagcugacuuccaacacacccaaucccgccccucauccggguccuccgucuccuccuucgccacacaauccucccgccccacacucaccaccaccaccggauccucacacggcaccgccuccucaaacucaacccgcuccacaucacucucacaauccacagucucccgcgccacaucacgcaccucagaauggguccgugaccaaaaccgaaaccucgaacccuacaugcacggcgcccuccaaaccgccuucguaaccccacccuccucccgcgccucagacggaaccgucucaaccguccccaaaggaguccuagacuccuggacccccgccuucaacacccgacgacaaccccucuucgcccaccuccgcaaacgcggugaaucccacgccuaa

SEQ ID NO: 39658 - RNA, 807 nt, Artificial Sequence
  derived and/or modified sequence opt11 from capsid_protein_VP2__Norovirus__AHI59163
auggccggcgcauucuucgccggccucgcauccgacguacuaggcucaggccuaggaucacuaauaaacgcaggcgccggagcaaucaaccaaaaagucgaauucgaaaacaaccgcaaacuccaacaagccuccuuccaauucagcuccaaccuacaacaggccuccuuccaacacgacaaagaaaugcuacaagcacaaaucgaagccacaaaaaaacugcaacaagaaaugaugagagucaaacaagccaugcuccucgaaggcggauucucggaaaccgacgcagccagaggcgcgauaaacgccccaaugaccaaaacacucgacuggucaggcacacgcuacugggcacccgacgccagaaucacaaccuacaacgccggcagauucccaaccccacaacucagcggagcacuaccaggccgagccaaccugcgcgcaacaguacccgcacgcgggagccccagcacaagcuccaacucaagcauagcaacaagcguauacucgaaccagaccacaagcacccgccuaggcucaaccgcaggcucaggcacuagcgucagcucccucccaagcacagcccgaaccagauccugggucgaagaccaaaacagaaaccuauccccauuccuccgaggagcccacaacaucagcuucgucacaccccccagcucacgauccagcucacaagggaccgucagcacaguccccaaagaaguccucgacucauggacaggcgcauucaacaccagacgccagccccuauucgcacacauacgcaaacgcggagaaucccgcgucuaa

SEQ ID NO: 39659 - RNA, 807 nt, Artificial Sequence
  derived and/or modified sequence opt11 from capsid_protein_VP2__Norovirus__AHI59166
auggcgggagcguucuuugcaggacucgcgagcgacguauuaggcucaggacugggaucucuaauaaacgcgggcgcgggcgcgaucaaucaaaaggucgaguucgagaacaaucgcaagcuccagcaagcgagcuuccaauuuagcucaaaccugcaacaggccucguuccagcacgauaaagagauguugcaagcgcaaauagaagcgaccaagaaauugcaacagggcaugaugaagguaaagcaagcgauguugcucgagggcggguucucggaaacggacgcagccaggggcgcgauaaaugccccgaugacaaaagcgcucgauuggucaggcacgcgcuauugggcgcccgaugccagaaccacgaccuauaacgcgggcagguucucaaccccucaaccgagcggggccuugccaggacgcaauaacuugcgcgcgaccgugcccgcgcgcgggagcucaagcacgcucucgagcauacccacggcuacuagcguguacucgaaccagacugugagcacgcgccugggaucgagcgcgggcucgggaacgagcgugagcucacucccgagcacggcuagaacccgaagcugggucgaggaccaaaacaagaacuugagcccguucaugcgcggggccuugaacacgagcuuugucacgcccccaagcucgcgcucaagcucgcaagggaccgugagcacggucccaaaagaaaucuuggacucguggacgggagcguucaauaccaggcgccagccauuguucgcgcacgugcgcaaacgcggagaaucacgaguauga

SEQ ID NO: 39660 - RNA, 807 nt, Artificial Sequence
  derived and/or modified sequence opt11 from capsid_protein_VP2__Norovirus__AHX22026
auggcgggcgcauucuucgccggacucgcaagcgacguccuaggcucaggccuaggcucacucauaaacgcaggcgccggagcaauaaaccaaaaagucgaguucgaaaacaaccgcaaacuccaacaagccagcuuccaauucagcucaaaccuacaacaagcauccuuccaacacgacaaagaaaugcugcaagcacaaauagaagcaaccaagaaacuacaacaggaaaugaugagagucaaacaaguaaugcuccucgaaggcggguucucagaaacagacgcagccagaggcgccaucaacgccccgaugacgaaagcccucgacugguccggcacacgcuacugggcccccgacgcaagaaccaccaccuacaacgcaggaagguucucgaccccacaaccaagcggagcccugcccggacgagcaaaccuacgagugaccgcacccgcacgcggaagcucaagcacaagcucgaacucguccauagccacaagcguauacucaagccagaccacguccacacgacuaggcucaacagcgggcucgggcacaagcguaagcucgcucccaagcacagccaggaccagaagcugggucgaggaccagaacaggaaccuaucccccuucaugcgaggggcccacaacaucagcuucgucacaccaccgagcucacgcucaagcucacaaggaaccguaagcacaguaccgaaagaaguccuagacucguggacaggcgcguucaacacaaggcgccaaccccuguucgcacacauacgcaaacgcggagaaucgcgcguauaa

SEQ ID NO: 39661 - RNA, 807 nt, Artificial Sequence
  derived and/or modified sequence opt11 from capsid_protein_VP2__Norovirus__AHX22029
auggcgggcgcauucuucgccggacucgcgagcgacguccugggcucgggacugggcucgcucauaaacgcgggagcgggagcgauaaaccaaaaggucgaguucgaaaacaaccgcaagcuacagcaagcgagcuuccaauucagcucgaaccugcaacaggcaucguuccaacacgacaaagaaaugcugcaagcgcaaauagaagcaaccaagaaacugcaacaggaaaugaugaagguaaagcaaguaaugcuacuagagggcggauucucagaaacagacgcagccaggggcgcgauaaacgcaccgaugacgaaagcacucgacuggucgggcacacgcuacugggcacccgacgccaggaccacgaccuacaacgcaggcagguucucaaccccgcaaccgagugggguccugccaggacgcgcgaaccuacgcgacgcaguccccgcgcgcgggagcucgagcaaaagcucgaacucguucacagccacguccguguacucgaaccaaaccacgagcacacgccugggcucaaccgcgggcuccggcacaaguguaagcucgcucccgaguacagccaggaccagguccugggucgaagaccagagcagaaacgugagcccguucaugcgcggggcccacaacaucagcuucgucacacccccgagcucgcgcucgagcucgcaaggcaccguaagcacagucccgaaagagguccuagacucauggacaggcgcauucaacaccaggcgccagcccuuauucgcccacauacgcaaacgcggagaaucccgcguguaa

SEQ ID NO: 39662 - RNA, 807 nt, Artificial Sequence
  derived and/or modified sequence opt11 from capsid_protein_VP2__Norovirus__AHX22033
auggcgggcgcauucuucgccggacucgcaagcgacguacugggcucgggcuugggaucgcucauaaacgcaggcgcgggagcgauaaaccaaaaagucgaguucgaaaacaaccgaaaacuacagcaagcgagcuuccaauucagcucgaacuugcaacaggccucguuccagcacgacaaagagaugcugcaagcacaaauagaagcaaccaagaaacuacaacaggaaaugaugagggucaaacaagugaugcugcucgagggcggguucucagaaacggacgcggccaggggcgcaaucaaugccccgaugacgaaagcgcuagacuggucuggcacgcgcuacugggcgcccgacgccagaacuacgaccuacaacgcaggcagguucucgaccccgcaaccaagcggggcccugagcgggcgcgcgaacuugcgcgcgaccgcgcccgcgcgcgggagcucaagcacgagcucgaacucuagcauagccacgagcguauacucaaaccagacaacaaguacgcgacugggcucgaccgcgggcucaggaacgagcguaucaucgcccccgagcacggccagaaccaggagcugggucgaggaccagaacaggaaccugagcccguucaugcgcggggcccauaacaucagcuuugucacacccccgagcucgcgaucgagcucacaagggacagugagcacagucccaaaagagguccuggacuccuggacaggcgcguucaacaccaggcgccaaccccuauucgcacacauacgcaagcgcggggaaucaagaguguga

SEQ ID NO: 39663 - RNA, 807 nt, Artificial Sequence
  derived and/or modified sequence opt11 from capsid_protein_VP2__Norovirus__AHX22036
auggcaggcgcauucuucgccggccuagccuccgacguccuaggcucaggccuaggcucacuuauuaacgccggcgcgggcgcaaucaaccaaaaaguagaauucgagaacaaccgcaaacuccaacaagccagcuuccaauucuccuccaaccuccaacaagcaucauuccaacacgauaaagaaaugcuacaagcccaaaucgaagccaccaaaaaacuacaacaagaaaugaugcgcgucaaacaagccauguuacucgaaggaggcuucuccgaaacagacgccgccagaggcgcaaucaacgccccaaugaccaaaacccucgacugguccggaacacgcuacugggcacccgacgcccgcaccaccaccuacaacgcaggccgcuucucgaccccccaacccagcggcgcccuacccggacgcgccucccucagagccaccgucccagcccgaggaagcucaagcauguccuccaacucaagcauagccaccuccgucuacuccaaccagaccacgagcacacgacucggcuccaccgccggcuccggcacauccgucagcucccucccaagcaccgcccgcacacgcuccugggucgaagaccaaaaccgaaaccuauccccauucaugcgcggcgcccacaacaucuccuucgucacgcccccguccucaauaucaagcucccaaggcaccguguccacagucccaaaagaaguccucgacuccuggaccggugccuucaacacccgccgccaaccacuauucgcccacauccgcaaacgcggcgaaucccgcguauaa

SEQ ID NO: 39664 - RNA, 807 nt, Artificial Sequence
  derived and/or modified sequence opt11 from capsid_protein_VP2__Norovirus__AHX22039
auggccggagcauucuucgccggccucgccagcgacguccucggcucaggccucggcucccucaucaacgcaggcgccggcgcaaucaaucaaaaagucgaauucgaaaacaaccgcaaacuccaacaagccucauuccaauucuccuccaaccuccaacaagccucauuccaacacgacaaagaaaugcuccaagcccaaauagaagcaaccaagaaacuacaacaagaaaugaugaaaguaaaacaagcgaugcuacucgaaggcggcuucuccgaaacagacgccgcccgaggcgccaucaacgccccaaugacaaaagcccucgacugguccggcacccgauacugggcaccagacgcccgcaccacaaccuacaacgccggcagauucucaaccccacaacccuccggcgcccuccccggccgcgccaaccuacgagacgccguccccgcccgcggaagcuccucaaaguccuccaacucauccacagccaccuccgucuacuccaaccaaaccaccagcacccgccucggcucaaccgccggcuccggaacaagcguauccucccucccaucaaccgcacgcacccgcuccugggucgaagaccaaucccgaaaccucuccccauucaugcgcggcgcacacaacauauccuucgucacccccccauccucccgcucgagcucacaaggcacaguauccacaguaccaaaagaaguccuagacuccuggacaggcgccuucaacaccagacgacaaccccucuucgcccacauacgaaaacgcggcgaaucccgcguauaa

SEQ ID NO: 39665 - RNA, 807 nt, Artificial Sequence
  derived and/or modified sequence opt11 from capsid_protein_VP2__Norovirus__AHX22042
auggcaggcgcauucuucgccggacuagccagcgacguccucggcucaggccuaggcucacucauaaacgcaggcgccggcgcaaucaaccaaaaagucgaauuugaaaacaaccgcaaacuccaacaagccagcuuccaauucuccucaaaccuacaacaagcaucauuccagcacgacaaagaaaugcuacaagcacaaauagaagccacaaagaaauuacaacaggaaaugaugaaagucaaacaagccaugcuacucgaaggcggcuucucugaaaccgacgccgcccgaggagcaaucaacgccccaaugacaaaagcccucgacuggucaggaacccgauacugggcacccgacgcccgaaccacaaccuacaacgcaggccgauucucaacaccccaacccagcgggguccuccccggacgcgcaaaccuacgcgacgcaguacccgcacgcggcuccucaagcaaaucaucaaacucauucaccgccaccuccguauacucaaaccaaaccaccuccacccgccuaggcucaacagcaggcucaggcacaagcguauccucacuaccgagcacagcaagaaccagauccugggucgaagaccaaagcagaaaccucagcccauucaugcgcggcgcccacaacaucagcuucgucacacccccaagcucacgcuccagcucacaaggaaccgucagcaccgucccaaaagaaguccuagacucauggacgggagccuucaacaccaggcgccagccccuauucgcacacauacgcaaacgcggagaaucacgcgucuaa

SEQ ID NO: 39666 - RNA, 807 nt, Artificial Sequence
  derived and/or modified sequence opt11 from capsid_protein_VP2__Norovirus__AHX22048
auggcaggcgcguucuucgccgggcuagcaagcgacguccugggcucaggacugagcucgcucauaaacgcgggcgcgggcgcaaucaaccaaaaggucgaguucgaaaacaaccgaaagcuccaacaagccagcuuccaauucagcucgaaccuacaacaggcaucguuccagcacgacaaagagauguugcaagcacaaauugaagcgaccaagaaacugcaacaggaaaugaugagaguaaagcaagcgaugcuacucgagggcggguucuccgaaacagacgcggccagaggcgcgaucaacgccccgaugacgaaagcgcucgacuggucgggcacacgcuacugggcacccgacgccaggaccacgaccuacaacgcaggaagguucuccacgccccaaccgagcggggcccugcccgggcgcgcgaaccuacgcgcagccgugcccgcgcgcgggagcucaagcaugagcucaaacucgaguaccgcaacaagcguguacucgaaccagaccacaagcacgcgccugggcucgaccgcgggaucgggcacgagcgugagcucgcuaccgagcacggcacggaucagaagcugggucgaagaccagaacagaaaccugagcccguucaugcgcggggcucauaacauauccuucgucacgcccccaagcucacgcucgagcucacaaggaaccguaagcacgguaccgaaagagguccuggacuccuggacgggcgcguucaacaccaggcgccagccccuauucgcgcacauacgcaagcgcggggaaucacgcgcauaa

SEQ ID NO: 39667 - RNA, 807 nt, Artificial Sequence
  derived and/or modified sequence opt11 from capsid_protein_VP2__Norovirus__AHX22051
auggcgggagcauucuucgccgggcuugcaagcgacguccugggcucgggccuaggaucacucauaaacgcgggcgcgggagcgaucaaccaaaagguugaguucgagaacaaccgcaagcuccaacaagcuagcuuccaauucagcucaaaccuacaacaggccucguuccagcacgacaaagagaugcugcaagcgcaaauagaagcaaccaagaaacugcaacaagaaaugaugagggucaagcaagcaaugcugcucgagggcggcuucucagaaacagacgcagccagaggcgcaaucaacgccccaaugacgaaaacgcucgacuggucgggcacacgcuacugggcgccagacgccagaaccacgaccuacaacgcgggcagguucuccaccccgcaaccaagcggggcccuccccgggcgcgcaucacuacgcgcgacaguacccgcacgaggcaguucaagcaugagcucgaacucgagcauagccacaagcguauacucgaaccagaccacaagcacaagacucggcucaaccgcaggaucgggcacaagcgugagcucacucccgagcacagcaaggacccgaaguugggucgaggaccagaacaggaaccuaagcccauucaugcgcggagcccacaacaucagcuucgucacgcccccaagcucaauaucaagcucacaagggaccgugagcacagucccgaaagagguccuagacucauggacgggcgcguucaacaccagacgccagccccuguucgcccacauccgcaagcgcggggaaucgcgcguauga

SEQ ID NO: 39668 - RNA, 807 nt, Artificial Sequence
  derived and/or modified sequence opt11 from capsid_protein_VP2__Norovirus__AHX22055
auggccggcgccuucuucgccggacuagcauccgacguccucggcuccggucucuccucacucauaaacgcaggagccggcgccaucaaccaaaaagucgaauacgaaaacaaccgcaaacuccaacaagccuccuuccaauucuccucaaaccuccaacaagccuccuuucaacacgacaaagaaaugcuccaagcccaaauagaagccaccaaaaaacuacaacaagaaaugaugcgcgucaaacaagccaugcuacuagaaggcggcuucuccgaaacagacgccgcccgcggcgccaucaacgcccccaugacaaaaacucucgacugguccggcacacgcuacugggcccccgacgcccgcaccacuaccuacaacgccggccgauucagcaccccucaacccuccggagcccuacccggccgcgcaaaccuccgcgccaccguccccgcccguggcuccucaagcaccuccucaaacucauccaucgccacauccguauacucaaaccaaaccacacucacacgccuaggcuccaccgcaggcuccggcacauccguauccucccuacccuccaccgcacggacacgauccugggucgaagaccaaaaccgcaaccuuucccccuucaugcgaggcgcccacaacauauccuucgucacuccacccucuucacgcuccuccucccaaggcaccguaucaaccguccccaaagaaguccuggacucguggaccggcgcauucaacacccgccgacaaccccucuucgcccacauccgcaaacgaggcgaaucacgagucuaa

SEQ ID NO: 39669 - RNA, 693 nt, Artificial Sequence
  derived and/or modified sequence opt11 from capsid_protein_VP2__Norovirus__AII02849
auggccggcgccuucaucgccggccucgcaggcgacaugcucaccaacaccgucggcucucuagucaacgcaggcgccaacgccaucaaccaaaccaucgacuucgaaaacaacaaauaccuccaaaacgcauccuucaaccacgacaaagaaaugcuaaacgcccaaaucgaagccaccaaacgccuccaagccgacaugaucgccaucaaacaaggcguccuaacugccggcggcuucucccccaccgacgccgcucgcggcgcaauaaacgcccccaugacaaaaguacucgacuggaacggcacacgcuacugggcccccggcgccaccuccaccaccagcaugucaggcggcuucauaaaccaaaccguacaccgcucaaccccaaacuucaaaaccaaccaagcacccaaacccgcccccuccucaggcuccuccguccgcuccaacuccacacaaaucaccucccuaucaucccacucauccggcucaucccgcuccuccggcuccacagucgucuccuccauccccuccucaaaccgaacccgcgacugggucaaccaacaaaacuucaaccucgaaccccacaugcccggaucccuccgcaccgccuucgucaccccacccuccucaaccgccuccuccagcggcaccgucuccaccguccccaaaaacguacuagacuccuaa

SEQ ID NO: 39670 - RNA, 804 nt, Artificial Sequence
  derived and/or modified sequence opt11 from capsid_protein_VP2__Norovirus__AKE07101
auggccggcgccuucuucgcaggccuagcaagcgacguccuaggcuccggacucggaucacuaaucaacgcaggcgccggcgccaucaaccaaaaagucgaauucgaaaacaaccgcaaacuacaacaagccuccuuccaauucucauccaaccuccaacaagcauccuuccaacacgacaaagaaaugcuccaagcccaaaucgaagcaaccaaaaaauuacaacaagaaaugaugaaagucaaacaagccguccuccucgaaggaggauucucagaaaccgacgccgcccgaggcgccauaaacgcccccaugacaaaagcacucgacugguccggcacccgcuacugggcccccgacgcccgcaccaccaccuacaacgccggccacuucuccaccccccaacccagcggcgccccccucgggcgcgccaaccuccgcgccgccguacccacacgcggaucauccucaaccuccuccaacuccagcauagccacauccgucuacuccaaccaaaccgcauccacccgccucggauccaccgccggaucaggcgccuccgucuccucacucccaagcaccgccagaacccgaucaugggucgaagaccaacgcaaccucucacccuucaugagaggcgcacacaacauaucauucguaaccccacccuccagccgcagcuccucccaaggcacagucucaaccguccccaaagaaguacucgacuccuggaccggcgcauucaacacacgcagacaaccccucuucgcacacauccgcaaacgcggcgaaucccgagucuaa

SEQ ID NO: 39671 - RNA, 807 nt, Artificial Sequence
  derived and/or modified sequence opt11 from capsid_protein_VP2__Norovirus__AKE07104
auggccggcgccuucuucgccggccucgccuccgacguccucggcuccggccucggcucacucaucaacgccggcgcaggcgccaucaaccaaaaagucgaguucgaaaacaaccgcaaacuccaacaagccuccuuccaauucuccucaaaccuacaacaagccucauuccaacacgacaaagaaaugcuccaagcccaaaucgaagccaccaagaaacuccaacaagaaaugaugaaggucaaacaagccguccuccucgaaggcggcuucuccgaaaccgacgcagcacgaggcgcaaucaacgcccccaugaccaaagcacucgacugguccggcacccgcuacugggcccccgacgccagaaccaccacuuacaacgccggccgcuucucaaccccacaaccauccggaauccuccccggccgcgccaaccuacgcgacaccgugcccgcccgcggcuccuccuccaccagcucaaaauccuccaucgccacgucccucuacuccaaccaaacagccaccacccgccucgguuccaccgcaggcucaggcaccagcgucagcucccuccccuccacagcccgcacaagauccugggucgaagaccaaaaccgaaaccuauccccauucaugcgcggcgcccacaacauauccuucgucacaccacccuccucccgcuccagcucacaaggcaccguaagcacaguccccaaagaaguccucgacuccuggacaggcgccuucaacacaagacgacaaccccucuucgcccacauacgcaaacgcggcgaaucccgcgucuaa

SEQ ID NO: 39672 - RNA, 807 nt, Artificial Sequence
  derived and/or modified sequence opt11 from capsid_protein_VP2__Norovirus__AKE07107
auggccggcgccuucuucgccggacucgcgagcgacguccucggcuccggccuaggcucacucauaaacgccggcgccggcgccaucaaccaaaaagucgaauucgaaaacaaucgaaaacuccaacaagcaucuuuccaauucucauccaaccuacaacaagccuccuuucaacacgacaaagacaugcuacaagcccaaaucgaagccaccaaaaaacuccaacaagaaaugaugcgaguaaaacaagcaaugcuccuagaaggcggcuucucagaaaccgacgcugcccgcggcgccaucaacgcccccaugaccaaagcacuagacugguccggcacccgcuacugggcccccgacgcacgcaccaccacauacaacgccggccacuucuccaccccccaaccauccggagcccucccaggccgcgcaaaccuccgcgccgccgucccagcacgcggccccuccagcacauccucaaacuccucaaccgcaaccuccgucuacuccaaccaaacaaccagcacccgccuaggcuccaccgcaggcuccggcgccuccguauccucacuacccuccaccgcccgcaccgucaacugggucagagaccaaaaccgcagccucucccccuucaugcgaggcgcccacaacaccagcuucgucacaccccccuccuccagauccuccucacaaggaaccgucuccaccgucccaaaagaaguccucgacuccuggaccggcgccuucaacacacgccgccaaccacuauucgcccacaucagaacccgcggcgaaucacgcgucuaa

SEQ ID NO: 39673 - RNA, 765 nt, Artificial Sequence
  derived and/or modified sequence opt11 from capsid_protein_VP2__Norovirus__ALE30634
auggccggcgccuucaucgcaggccucgcaggagacaugcucaccaacaccgucggcucccucgucaacgccggcgccggcgccaucaaccaaaaagucgacuucgaaaacaauaaauaccuccaaaacgccucuuucaaccacgacaaagaaaugcucaacgcccaaaucgaagccaccaaacgccuccaagccgacaugaucgccaucaaacaaggcguccuaaccgcaggcggauucucacccaccgacgcugcacgcggcgcaaucaacgccccaauaaccaaaguccucgacugguccggaacccgauacugggcccccaacgccaccuccaccacauccauguccggcggcuucaccggccaagccguccaccgcgcaacccccaacuucaagaccaaccaagcccccaaauccacccccuccuccggcuccuccguccgcucauccuccacacaacucacaaaucucuccucccacuccucaggauccucccguuccuccggcuccaccauggucuccucccuccccuccuccucacgaacccgcgauugggucaaccaacaaaacuucaaccucgaaccccacaugccaggcucccuccgcaccgcauucgucaccccacccuccuccaccgcauccucccuugacaccgucuccacagucccaaaaucaguccucgacucauggacccccgccuucaacacucgccgucaaccccucuucgcacaccuccgccgccgaggcgaauccaacaucuaa

SEQ ID NO: 39674 - RNA, 765 nt, Artificial Sequence
  derived and/or modified sequence opt11 from capsid_protein_VP2__Norovirus__ALE30636
auggcaggagccuucaucgccggccucgcaggagacaugcuuaccaacaccgucggaucacucgucaacgccggcgccggcgccaucaaccaaaaagucgacuucgaaaacaacaaauaccuacaaaacgccuccuucaaccacgacaaagaaaugcucaacgcccaaaucgaagccaccaaacgccuccaagccgacaugaucgccaucaaacaaggcguccucacagccggcggauucucacccaccgacgccgcccgaggcgccaucaacgcacccauaaccaaaguacuugacugguccggcaccagauacugggcccccaacgccaccuccaccaccuccauguccggcggauucaccggucaagccguccaccgcgcaacccccaacuucaaaaccaaccaagcccccaaaucaacccccucauccggcuccuccguccgcuccuccuccacccaacucaccaaccuauccucacacuccuccggcucaucacgaucauccggcucaaccaugguaucaucccucccuuccuccucccgaacccgcgacuggguaaaccaacaaaacuucaaccucgaaccccacaugcccggcucccuacgcaccgccuucgucaccccacccuccuccacagccuccucccucgacaccgucucaaccguccccaaauccguacucgacuccuggaccucagccuucaacacccaccgccaaccccucuucgcacaccuccguaaacgaggcgaaucaaacgucuaa

SEQ ID NO: 39675 - RNA, 780 nt, Artificial Sequence
  derived and/or modified sequence opt11 from capsid_protein_VP2__Norovirus__BAR42290
auggcaggcgccuucauagccggccucgccggcgacaugcucaccuccuccguaggcucccucgucaacgcuggcgcuaacgccaucaaccaaaaaauagacuucgaaaacaacaaacaacuccaaucagccucauuucaacacgacaaagaaaugcuucaagcccaaguccgcgcaaccaaacaacuccaauccgaaaugaucgcccucaaacaaggcguccucgccgccggcggcuucucccccacagacgccgcccgaggcucaaucggcgcacccaugaccaaaguccucgacugguccggcacccgcuacugggcccccaacuccacaaaaaccaccggcuacucuggccaauucaccucaucccccguccacaugucaucacccaacgccccccaaucaaaacccgccaaaccccgcucccucgcccccuccucauccuccuccuccgucuacuccauguacacccaauccacccaccuaaccuccggcuccuccuccaacgccucauccgccucuaccaaacucaccucccucucaucaggaucaucucaaaaccgcaccgccgaaugggucaaccaacaacgcucccucucccccuucauguccggugcccucaacaucucccacgucacccccccauccucccgcgccuccuccuccggcaccguauccaccguaccuaaagaaguacucgacuccuggacaucagcauucaacacccaccgccaaccccucuucgcccaccuucgcguccgcggcgaaucccgagucuaa

SEQ ID NO: 39676 - RNA, 780 nt, Artificial Sequence
  derived and/or modified sequence opt11 from capsid_protein_VP2__Norovirus__BAR47617
auggcaggcgccuucaucgccggccuugccggcgacaugcucaccucauccgucggcucccuagucaacgccggcgccaacgcaaucaaccaaaagaucgacuucgaaaacaacaaacaacuccaauccgccuccuuccaacacgacaaagaaaugcuacaagcccaagucaaagccaccaaacaacuccaaucagagaugaucgcccucaaacaaggcguccucgcagccggcggcuucucccccaccgacgccgcccgaggcgcaaucggcgcccccaugaccaaaguacucgacugguccggcacacgcuacugggcacccaacucuaccaaaacaaccggcuacucaggccaauucaccucauccccuguccacaugcccucccccaacgccccacaauccaaaccagccaaaccccgcucccucgcccccucauccuccucauccuccgucuacuccauguccacacaauccacccaccucaccuccggaucuuccucaaacgccucauccgccucaaccaaacucaccaaccucuccucaggcuccucacaaaaccgaaccgcugaaugggucaaccaacaacgaucacucucccccuucauguccggcgcacucaacaucucucacgucacgcccccaucuucccgcgccuccuccuccggcaccgucuccaccguccccaaagaaguccucgacucauggacauccgccuucaacacccaccgccaaccccucuucgcccaccuccgcguccgcggcgagucccgcgucuaa

SEQ ID NO: 39677 - RNA, 780 nt, Artificial Sequence
  derived and/or modified sequence opt11 from capsid_protein_VP2__Norovirus__BAR63716
auggccggcgccuucaucgccggacucgccggcgacaugcucaccuccuccguaggcucccucgucaacgccggcgccaacgcaaucaaccagaaaaucgacuucgaaaacaacaaacaacuccaaucagccuccuuccaacacgacaaagaaaugcuccaagcccaagucaaagccacaaaacaacuccaauccgaaaugaucgcccucaaacaaggcguccucgccgccggcggauucucccccaccgacgccgcccgaggcgccauaggcgcccccaugaccaaaguacucgacuggucuggcacccgcuacugggcccccaacuccaccaaaacaaccggcuacuccggacaauucaccuccucacccguccgaaugcccucccccaacgcuccacaaucaaaacccgccaaaccccgcucccucgcccccuccuccuccuccuccuccgucuacucaaugucuacacaauccacccaccuuacaucaggcuccuccuccaacgccuccuccgccuccacaaaacucaccaaccucuccuccggcucaucccagaaccgcaccgccgaauggguaaaccaacaacgcucucucucccccuucauguccggcgcacucaacaucucccacgucaccccacccuccucccgcgccucuucauccggaaccgucuccaccguccccaaagaaguccuagacucauggaccuccgccuucaacacacaucgacaaccccucuucgcccaccuacgcguccgcggagaaucccgagucuaa

SEQ ID NO: 39678 - RNA, 780 nt, Artificial Sequence
  derived and/or modified sequence opt11 from capsid_protein_VP2__Norovirus__BAR63719
auggccggcgccuucaucgcaggccucgccggagacaugcucacauccucagucggcucccuaguaaacgcaggcgccaacgccaucaaccagaaaauagacuuugaaaacaacaaacaacuccaaucagcaucauuccaacacgacaaagaaaugcuccaagcacaagucaaagcuaccaaacaacuccaauccgaaaugaucgcucucaaacaaggcguccuagccgccggcggcuucucccccacagacgccgcccgcggagcaauaggcgcacccaugaccaaaguacucgacugguccggaacccgauacugggcccccaacuccaccaaaacaaccggcuacuccggccaauucaccuccucccccguccacaugcccuccccuaacgcaccccaauccaaacccgccaaaccacgcucccuagcccccucuuccucaucauccuccgucuacucaauguccacccaauccacccaccucaccuccggcuccuccuccaacgccuccuccgccuccaccaaacucaccaaccucuccuccggcuccucccaaaaccgcaccgccgaauggguaaaccaacaacgcucccucucccccuucauguccggcgcccucaacaucucacacguuaccccgccauccucccgcgccucauccuccggcaccgucuccacagucccaaaagaaguccucgacuccuggaccuccgccuucaacacccaccgccaaccccucuucgcacaccuccgcguccgcggcgaaucccgagucuaa

SEQ ID NO: 39679 - RNA, 780 nt, Artificial Sequence
  derived and/or modified sequence opt11 from capsid_protein_VP2__Norovirus__BAR63722
auggccggcgccuucaucgcaggccucgccggcgacaugcuaaccagcucagucggcucccucgucaacgccggcgccaacgccauaaaccagaaaaucgacuucgaaaacaacaaacaacuacaauccgcaucauuccaacacgacaaagaaaugcuccaagcccaagucaaagcaaccaaacaacuacaauccgaaaugaucgcccucaaacaaggcguccuagccgccggcggcuucucccccacagacgccgcccgaggcgccaucggcgcccccaugaccaaaguacuagacuggucuggcacacgcuacugggcccccaacucaacaaaaacaaccggauacucaggccaauucacaucaucccccguccacaugcccucccccaacgcaccccaaucaaaacccgccaaaccccgaucacuagcccccucaucauccucauccuccgucuacuccauguccacccaauccacccaccucaccuccggcuccuccucuaacgccuccucugccuccaccaaacucaccaaccucuccucaggaucuucccaaaaccgcacagccgaaugggucaaccaacaacgaucccucucccccuucaugucaggagcccucaacaucucccacguaaccccucccucuagccgcgccuccuccuccggcaccgucuccacaguccccaaagaaguacuagacuccuggaccucagcauucaacacccaucgccaaccccuauucgcccaccuccgcguccgcggagaaucccgcguuuaa

SEQ ID NO: 39680 - RNA, 807 nt, Artificial Sequence
  derived and/or modified sequence opt11 from capsid_protein_VP2__Norovirus__BAS02084
auggcgggcgcguucuucgccggacucgcuagugacguccugggcucaggccugggcucacucauaaacgcgggcgcaggcgcgaucaaucaaaaagucgaguucgagaacaacagaaagcuacagcaagccagcuuccaauucagcucaaaccugcaacaggcaucauuccagcacgacaaagaaaugcuacaagcacaaauagaagcaaccaagcgccugcaacaggaaaugaugaaggucaaacaagcgaugcuacucgagggcggguucucagaaacggacgcagcaaggggcgcaaucaacgccccgaugacaaaagcacucgacuggaauggcacgagauacugggcaccagacgccaggaccacaaccuacaacgcaggcagauucucaaccccgcaaccgagcggcgcccuccccgggcgagcaaaccuacgcgacgccguacccgcgcgcgggagcucgagcaagagcuccaacucauccacggccacgagcguauacucgaaccagaccauaagcacccgccuaggcucaaccgcgggcucaggcacgagcgugagcucauucccaaguacggcccggaccagaagcugggucgaagaccaaagccgaaaccuaagcccauucaugcgcggagcccacaacaucagcuucgucacgcccccaagcucacgcucaagcucgcaagggaccgugagcacggucccacgcgagauccuagacucauggaccggagcguucaacaccaggcgccaaccccuauucgcacacauacgaaagcgcggggaaucgcgaguauaa

SEQ ID NO: 39681 - RNA, 627 nt, Artificial Sequence
  derived and/or modified sequence opt11 from capsid_protein_VP2__Norovirus__CRL46953
auggcccaagccaucaucggcgccaucgccgccuccgccgccggcuccgcccucggcgccggcauccaagccggcgccgaagcagcccuccaagcccaacgcuaccaacaagaccuaacccuccaacaaaacuccuucaaccacgacaaagaaaugcucggcuaccaagucgaaaugucuaacaaacuccucgccaaaaaccucaacacccgcuacucccuccuccaagccggcggccucucccccucagacgccgcccgagccgucgccggagcccccguaacccgccucgucgacuggggcggcguccgagucgccgcuccccaauccucagccaccacccuccgcuccggcaacuucauggccgucccccuccccgcccaaccaaaacaaaaaccccucgccuccgaaggcuacucuaaccccgccuacgaccccaugcaacgcaccgccucauggguccaaucccaaaacucgucacguaacuggucccccuaccaccgccaagcacuccaaacagucugggucaccccacccggcuccaccuccuccuccuccgucuccaccgcaccccgaggcuacuucaacacagaccgccuaccccucuucgccaaccuccgacgcuaa

SEQ ID NO: 39682 - RNA, 630 nt, Artificial Sequence
  derived and/or modified sequence opt11 from capsid_protein_VP2__Norovirus__CRL46956
auggcccaagccgucaucggcgccaucgccgccuccgccgcaggcucaauccucggcgccggcauccaagccggcgccgaagccggccuacaagcccaacgcuaccaacaagaccuccaacuccaacaaaacuccuucaaacacgacaaagaaaugcucggcuaccaaguccaagcauccaacgcacuccucgccaaaaaccuaaacacccgcuacgcccuacuccaagccggcggacucuccucagccgacgccgcccgagcagucgccggcgcccccgucacccgcaucgucgacuggaacggcaccagaaucgcagcccccgccuccucagccacaacccuccgauccggcggcuucauggccguccccaucccccuuuccuccaaaaccaaacaacccgucauguccggccaagacaaccccaacuacgcagcauccuccaucucccgcacagccucauggguccaaucccaaaacuccaugcgcucagucucucccuuccacuccgacgcccuccgcaccgucugggucaccccacccggauccuccucaaccuccuccguccaauccuccuucuacggcgucuucaacaccgaccgccucccccucuucgccaaccgccgcuaa

SEQ ID NO: 39683 - RNA, 807 nt, Artificial Sequence
  derived and/or modified sequence opt11 from capsid_protein_VP2__Norovirus__CRL46959
auggccggcgcauucuucgcaggacucgcaagcgacguacuaggcucaggccuaagcucacucauaaacgcaggcgccggcgcaaucaaccaaaaaaucgacuucgaaaacaaccgaaaacuccaacaagcaagcuuccaauucagcuccaaccuacaacaagccucauuccaacacgacaaagaaaugcuacaagcacaaguagaagcaaccaaaaaacugcaacaagaaaugaugaaagucaaacaagcaauccuccucgaaggcggcuucucagccacagacgcagcccgaggcgcaaucaacgccccaaugaccaaaguacucgacuggaacggcacacgcuacugggcgccagacgcccgcaccaccaccuacaacacaggccacuucuccaccccacaaucgagcggcgcccucccaggccgaacaaacccccgcauacccacgcccgcccgcgcaagcucgagcacaagcucaaacgcgagcacagccacaagcaucagcuccaaccaaaccguaagcacccgccuaggcuccacagcaggauccggaaccaacguauccucccucccaagcacagccagaacccggagcugggucgaagaccaaaaccgaaaccuaagcccauucaugcgaggagcccacaacauaagcuucgucacacccccaagcucacguucauccucacaaggaaccguaagcacaguccccaaaggcguccuagacucauggacaggagccuucaacacaagacgccaaccccuauucgcauacacacaccgacgcggagaaucacgaguuuaa

SEQ ID NO: 39684 - RNA, 807 nt, Artificial Sequence
  derived and/or modified sequence opt11 from capsid_protein_VP2__Norovirus__CRL46962
auggccggcgcguucuucgccggacucgcauccgacguccuaggcuccggccucggcucccuuauaaacgcaggcgccggcgccaucaaccaaaaaguagaauucgaaaacaaccgcaaacuccaacaagcaucauuccaauucagcucaaaccuacaacaagccucauuccaacacgacaaagaaaugcuccaagcucaaaucgaagccaccaaaaaacuccaacaagaaaugaugaaagucaaacaagcaaugcuccucgaaggcggauucucagaaacugacgccgcccgaggcgccaucaacgcccccaugacaaaagcccucgacugguccgguacccguuacugggcccccgacgcacgcaccaccaccuacaacgccggccgauucuccaccccacaaccauccggcgcccucccaggccgcgcaaaccuccgagacgccguccccgcacgcggccccuccuccaaauucucaaauuccuccaccgccaccuccgucuacucaaaccaaaccauauccacccgccucggcuccaccgccggcuccggcaccuccgucagcucccuccccuccacagcccgaacccgauccugggucgaagaccaaucacgcaaccucucccccuucaugggcggagcccacaacaucuccuuugucaccccccccuccucccgcucauccucacaaggcaccgucuccaccguccccaaagaaauccuugacuccuggaccggcgccuucaacacccgacgccaaccccucuucgcccacauccgcaaacguggcgaaucccgcgucuaa

SEQ ID NO: 39685 - RNA, 807 nt, Artificial Sequence
  derived and/or modified sequence opt11 from capsid_protein_VP2__Norovirus__CRL46965
auggcaggcgcguucuuugcagggcucgcgagcgauguccugggcucgggcuuaggcucgcucauaaacgcgggcgcgggagcaaucaaucaaaaagucgaguucgaaaacaaccgcaagcuccaacaagcgagcuuucaauuuagcucaaaccuacaacaggccucguuccagcacgacaaagagaugcugcaagcacaaauagaagcgaccaagaaauugcaacaagaaaugaugaaagucaagcaagcgguacugcuagagggaggguucucggaaacagacgcggcccggggcgcgaucaacgccccgaugacaaaagcacucgauuggucgggcacgcgcuauugggcgcccgacgccagaaccacgaccuacaacgcgggcagguucucuaccccgcaaccgagcggggcccugcccgggcgcgcgaaccugcgcgaugccgcgcccgcgcgcgggaguucgagcaagagcucgaacucguucacagccacgagcguguacucaaaccagaccacgagcacgcgacugggaucaaccgcuggaucgggaacgagcgucagcucacucccgagcacagcaaggacaagaagcugggucgaggaccagagcagaaaccugagccccuucaugcgcggggcccacaacauaaguuucguaacgcccccgagcucgcgcucgagcucacaagggaccguaagcacgguaccgaaagaggucuuggacucguggacgggcgcauucaauaccaggcgccagccauuguucgcacacauacgcaggcgcggagaaucgcgcguguaa

SEQ ID NO: 39686 - RNA, 777 nt, Artificial Sequence
  derived and/or modified sequence opt11 from capsid_protein_VP2__Norovirus__CRL46968
auggcuggcgcuuuccuagccggccucgucggcgacgccauaaccuccggcgucggcucccuuaucaacgccggcgccaacgccaucaaccaaaaagucgaauacgacuucaacaaacaacuacaacuugcaucuuuuaaacacgacaaagaaaugcuccaaagccaaguccuagccaccaaacaacuccaacaagaaaugaugaacauccgccaaggaguccuauccgccggcggcuucucccccaccgacgccgcccgcggcgccguaaacgcccccaugacaaaaauccucgauuggaacggcacccgauacuucgcccccaacuccaugaaaaccacauccuacuccggccaauucuccuccaaccccguccaccgccaacccaccucaccccgcuccgacccacccaaaaucaaagucaacuccgacuccgccuccgucuacuccucugccuccuccgcacccucccaauccacccacuccaccgcacucacagccggcagcucaucaucccgaaccaccuccuccuccgccgcagccucaacccuaucccgcaccuccgacuggguccgcggccaaaacgaacgccucucacccuucauggacggcgcccuccaaaccaccuucgucaccccacccuccucaaaagccuccucauacggcuccguauccaccguccccaaagccguccucgacuccuggacccccauguucaacacccaccgccaaccccucuucgcacacguacgccgccgcggcgaaucacaaaucuaa

SEQ ID NO: 39687 - RNA, 765 nt, Artificial Sequence
  derived and/or modified sequence opt11 from capsid_protein_VP2__Norovirus__CRL46971
auggccggagcauucaucgccggccuagccggcgacaugcucaccaacaccgucggaucucucgucaacgccggagccaacgccauaaaccaaaccaucgaccucgaaaacaacaaauaccuccaaaacgccuccuucaaccacgacaaagaaaugcuaaacgcccaaaucgaagccaccaaaaaacuccaagccgacaugaucgccaucaaacaaggcguccucaccgccggcggcuucucccccacagacgccgcccgaggcgccaucaacgcccccaugaccaaaguccucgacuggaacggcacccgccacugggccccaggcgccaccuccacaaccuccaugucgggcggcuucacacaccaaaccguucaccgcucaacacccaacuucaaaacaaaccaagcccccaaauccaccccauccuccgguuccuccguucgcuccaacuccacccaaaucaccucccuauccucucacuccuccggcucuucccgcuccagcgguuccaccgucauccgcuccauccccuccuccgaccgaacacgcgacugggucaaccaacaaaacuucaaccucgaaccccacaugcccggcucccuccgcaccgcauucgucaccccccccucguccaccgccuccuccucuggcacagucuccacaguacccaaaaacguccucgacucauggaccuccgccuucaacacccgccgacaaccccucuucgcccaccuccgccgacgcggcgaauccaacgucuaa

SEQ ID NO: 39688 - RNA, 771 nt, Artificial Sequence
  derived and/or modified sequence opt11 from capsid_protein_VP2__Norovirus__CRL46974
auggccggagccuucgucgcaggccucgccggcgacaucgucaccaacucaaucggcucccuagucaacgccggcgccaacgccaucaaccaaaaagucgacuucgaaaacaacaaacaacuccaacaagccucauucaaccacgaccaagaaaugcuucaagcacaaauccaagcaacaaaacaacuccaagccgacaugaucgcccuacgccaaggcguacucaccgccggaggcuucagccccaccgacgccgccagaggcgccgucaacgcccccaugacccaaguccucgauugguccggcacccgauacugggcccccggcgccaccaaaaccaccgccuucuccggcggcuucaccuccucccccaacacccgcacaaucguacccaaaaaaacauccgccacccccgccuccaccuccgucucccgcccauccucacucgccuccaccgccuccacccgcuccaccuucguauccggcaccuccucccucucaucauccacccgcuccuccuucaacucacaaccuacauccuccuccucacgaaccuccgaauggguccgcucucagaaccgcguccucgaaccauacaugcgcggcucacuacaaacagccuucgucacaccccccuccucccgcgcaucauccaacggcaccguauccacaguacccaaagaaguccuagacucauggaccuccgucuucaacacccaccgccaaccacuauucgcacaccuccgccgccgcggugaaucccaagucuaa

SEQ ID NO: 39689 - RNA, 807 nt, Artificial Sequence
  derived and/or modified sequence opt11 from capsid_protein_VP2__Norovirus__CRL46977
auggcaggcgcauucuucgccggacucgcgucagacguccugggcucaggacuaggcucacucauaaacgccggcgcaggcgcaaucaaccaaaaagucgaguucgaaaacaaccgaaaacuccagcaagccagcuuccaauucuccucaagccugcaacaagcauccuuccagcacgacaaagaaaugcuacaagcacaaauagaagcaaccaagaaacugcaacaagaaaugaugagagucaaacaagcgaugcuacuagaaggcggcuucucagaaacagacgcagccagaggcgcgaucaacgccccgaugacaaaaacgcucgacuggucaggcacgcgcuacugggcaccagacgcccgaaccacaacauacaacgcaggcagauucucuaccccgcaaccaagcggggcccugcccggacgcgcaaaccugcgcgcaaccgcccccgcgagagggagcuccagcaugagcuccaacucauccauagccacaagcguauacucaaaccagaccacgagcacacgccuaggcucaaccgcaggcucaggcacgagcguaagcucacucccgagcacggccaggaccagguccugggucgaagaccagaacagaaaccugagcccauucaugcgaggagcacacaacaucagcuucgucacacccccgagcucacgcuccagcucacaagggacagucagcacagucccaaaagaaguccucgacucauggacaggcgcguucaacaccagaagacagcccuuguucgcgcacauacgaaaacgcggagaaucgcgcgcauaa

SEQ ID NO: 39690 - RNA, 807 nt, Artificial Sequence
  derived and/or modified sequence opt11 from capsid_protein_VP2__Norovirus__CRL46980
auggcgggcgcauucuuggccgggcucgcgagcgacgucuugggcucaggccugggcucacucaucaacgcgggcgcgggagcaaucaaccaaaaagucgaguucgaaaacaaccgcaagcuccagcaagcgagcuuccaauucagcucgagccugcaacaggcaucguuccagcacgacaaagagauguuacaagcacaaauagaagcaaccaagaaacugcaacaggaaaugaugagagucaaacaagcgaugcugcucgagggcggauucucagaaacagacgcggccaggggcgcgaucaacgccccgaugacgaaaacgcucgacuggucuggcacgcgcuacugggcgccagacgccaggaccacgaccuacaacgcaggcagguucucaaccccacaaccaagcggggcccuacccgggcgagcaaaccugcgcgcaaccgcgcccgcacgcgggagcucaagcaugagcucgaacucgagcauagcaacgagcguauacucaaaccagaccacgaguacacgcuugggcucgaccgccggcucgggcacaagcgugagcucacucccgagcacggccaggaccagaagcugggucgaggaccagaacaggaaccuaagcccguucaugcgcggagcccauaacaucagcuucgucacaccaccgagcucgcgcucgagcucacaagggacagugagcacggucccgaaagagguccuggacucguggacgggcgcguucaacaccaggcgccagccccuguucgcgcacauacgcaaacgcggggaaucacgcgcauga

SEQ ID NO: 39691 - DNA, 42 bp, Artificial Sequence
  5'-UTR of human ribosomal protein Large 32 lacking the 5' terminal oligopyrimidine tract
ggcgctgcctacggaggtggcagccatctccttctcggcatc

SEQ ID NO: 39692 - RNA, 42 nt, Artificial Sequence
  5'-UTR of human ribosomal protein Large 32 lacking the 5' terminal oligopyrimidine tract mRNA
ggcgcugccuacggagguggcagccaucuccuucucggcauc

SEQ ID NO: 39693 - DNA, 75 bp, Artificial Sequence
  5'-UTR of human mitochondrial ATP synthase subunit alpha lacking the 5' terminal oligopyrimidine tract
gcggctcggccattttgtcccagtcagtccggaggctgcggctgcagaagtaccgcctgcggagtaactgcaaag

SEQ ID NO: 39694 - RNA, 75 nt, Artificial Sequence
  5'-UTR of human mitochondrial ATP synthase subunit alpha lacking the 5' terminal oligopyrimidine tract mRNA
gcggcucggccauuuugucccagucaguccggaggcugcggcugcagaaguaccgccugcggaguaacugcaaag

SEQ ID NO: 39695 - DNA, 110 bp, Artificial Sequence
  3'-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 39696 - RNA, 110 nt, Artificial Sequence
  3'-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 39697 - DNA, 108 bp, Artificial Sequence
  3'-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 39698 - RNA, 108 nt, Artificial Sequence
  3'-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 39699 - DNA, 132 bp, Artificial Sequence
  3'-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 39700 - RNA, 132 nt, Artificial Sequence
  3'-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 39701 - DNA, 44 bp, Artificial Sequence
  Center, alpha-complex-binding portion of the 3'UTR of an alpha-globin gene (muag)
gcccgatgggcctcccaacgggccctcctcccctccttgcaccg

SEQ ID NO: 39702 - RNA, 44 nt, Artificial Sequence
  Center, alpha-complex-binding portion of the 3'UTR of an alpha-globin gene (muag) mRNA
gcccgaugggccucccaacgggcccuccuccccuccuugcaccg

SEQ ID NO: 39703 - DNA, 186 bp, Artificial Sequence
  3'-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 39704 - RNA, 186 nt, Artificial Sequence
  3'-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 39705 - DNA, 186 bp, Artificial Sequence
  3'-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 39706 - RNA, 186 nt, Artificial Sequence
  3'-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 39707 - DNA, 187 bp, Artificial Sequence
  3'-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 39708 - RNA, 187 nt, Artificial Sequence
  3'-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 39709 - DNA, 24 bp, Artificial Sequence
  histone stem-loop sequence
caaaggctcttttcagagccacca

SEQ ID NO: 39710 - RNA, 24 nt, Artificial Sequence
  histone stem-loop sequence mRNA
caaaggcucuuuucagagccacca

SEQ ID NO: 39711 - DNA, 13 bp, Artificial Sequence
  Kozak
gccgccaccatgg

SEQ ID NO: 39712 - RNA, 13 nt, Artificial Sequence
  Kozak
gccgccaccaugg

SEQ ID NO: 39713 - RNA, 1840 nt, Artificial Sequence
  mRNA product wild type from capsid_protein__Norovirus__AFN70960.1
gggagaaagcuuaccaugaagauggcgucuaaggacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggccccgaucugaaucccuaccuuucucauuuggccagaauguacaauggcuaugcugguggcuuugaagugcagguaauccuugcggggaaugcguucaccgccgggaaagucauauuugcagcagucccaccaaauuucccaacugaaggcuugagccccagccaggucacuauguucccccauauaguaguagauguuaggcaacuggaaccuguguugauccccuuaccugauguuaggaacaauuucuaucacuacaaccaaucaaaugaccccaccauuaaacugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcagaugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggucacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguacccuaacaugaauuuggauugccuacucccccaagaaugggugcagcacuucuaccaagaggcagcuccagcacaaucugauguggcucugcuaagauuugugaauccagacacagguaggguucuauuugagugcaaacuucauaaaucaggcuaugucacaguggcucacacuggccagcaugauuuggucaucccccccaauggcuacuuuagauuugauuccugggucaaccaauucuacacacuugccccccugggaaaugggacggggcguagacgugcauuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39714 - RNA, 2005 nt, Artificial Sequence
  R4863/R4864 mRNA product wild type from capsid_protein__Norovirus__AFN70960.1
ggggcgcugccuacggagguggcagccaucuccuucucggcaucaagcuuaccaugaagauggcgucuaaggacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggccccgaucugaaucccuaccuuucucauuuggccagaauguacaauggcuaugcugguggcuuugaagugcagguaauccuugcggggaaugcguucaccgccgggaaagucauauuugcagcagucccaccaaauuucccaacugaaggcuugagccccagccaggucacuauguucccccauauaguaguagauguuaggcaacuggaaccuguguugauccccuuaccugauguuaggaacaauuucuaucacuacaaccaaucaaaugaccccaccauuaaacugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcagaugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggucacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguacccuaacaugaauuuggauugccuacucccccaagaaugggugcagcacuucuaccaagaggcagcuccagcacaaucugauguggcucugcuaagauuugugaauccagacacagguaggguucuauuugagugcaaacuucauaaaucaggcuaugucacaguggcucacacuggccagcaugauuuggucaucccccccaauggcuacuuuagauuugauuccugggucaaccaauucuacacacuugccccccugggaaaugggacggggcguagacgugcauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39715 - RNA, 1840 nt, Artificial Sequence
  mRNA product opt from capsid_protein__Norovirus__AFN70960.1
gggagaaagcuuaccaugaagauggccagcaaggacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccggcggcgaguucaccguguccccgcggaacgcccccggggagauccuguggagcgcgccccuggggccggaccucaaccccuaccugucccaccuggcccgcauguacaacggcuacgccgggggcuucgaggugcaggucauccucgccgggaacgccuucacggcgggcaaggugaucuucgccgccgugccgcccaacuuccccaccgaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggccaacaacgcgggcgaggacgucuucaccguguccugccgcgugcugacccggccgagccccgacuucgacuucaucuuccucgucccgcccaccguggagucccgcacgaagccguucaccgugcccauccugaccgucgaggagaugaccaacagccgguuccccaucccccuggagaagcucuucacgggcccguccggggccuucgugguccagccccagaacggccgcugcaccaccgacggggugcugcugggcaccacgcagcucagccccgugaacaucugcaccuuccggggcgacgucacccacaucgccgggacccacaacuacacgaugaaccuggccucccagaacuggaacaacuacgacccgaccgaggagauccccgccccgcugggcacccccgacuucguggggcgcauccagggcaugcucacccagacgacccggggcgacgggagcacccgcggccacaaggcgaccguguccacgggggacguccacuucaccccgaagcugggcagcauccaguucaacaccgacaccaacaacgacuucgagacggggcagaacaccaaguucacccccgugggcgugguccaggacgggaacggcacccaccagaacgagccccagcagugggugcugcccuccuacagcggccggacggggcacaacgugcaccucgccccggccgucgcccccaccuuccccggcgagcagcugcuguucuuccgcagcaccaugcccgggugcuccggcuacccgaacaugaaccucgacugccugcugccccaggagugggugcagcacuucuaccaggaggccgcgcccgcccagagcgacguggcccuccugcgguucgucaaccccgacaccgggcgcgugcuguucgagugcaagcuccacaaguccggcuacgugaccgucgcccacacgggccagcacgaccuggugaucccgcccaacggguacuuccgguucgacagcugggugaaccaguucuacacccuggcgccccucggcaacgggaccggccgccggcgcgcccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39716 - RNA, 2005 nt, Artificial Sequence
  R4865/R4866 mRNA product opt from capsid_protein__Norovirus__AFN70960.1
ggggcgcugccuacggagguggcagccaucuccuucucggcaucaagcuuaccaugaagauggccagcaaggacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccggcggcgaguucaccguguccccgcggaacgcccccggggagauccuguggagcgcgccccuggggccggaccucaaccccuaccugucccaccuggcccgcauguacaacggcuacgccgggggcuucgaggugcaggucauccucgccgggaacgccuucacggcgggcaaggugaucuucgccgccgugccgcccaacuuccccaccgaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggccaacaacgcgggcgaggacgucuucaccguguccugccgcgugcugacccggccgagccccgacuucgacuucaucuuccucgucccgcccaccguggagucccgcacgaagccguucaccgugcccauccugaccgucgaggagaugaccaacagccgguuccccaucccccuggagaagcucuucacgggcccguccggggccuucgugguccagccccagaacggccgcugcaccaccgacggggugcugcugggcaccacgcagcucagccccgugaacaucugcaccuuccggggcgacgucacccacaucgccgggacccacaacuacacgaugaaccuggccucccagaacuggaacaacuacgacccgaccgaggagauccccgccccgcugggcacccccgacuucguggggcgcauccagggcaugcucacccagacgacccggggcgacgggagcacccgcggccacaaggcgaccguguccacgggggacguccacuucaccccgaagcugggcagcauccaguucaacaccgacaccaacaacgacuucgagacggggcagaacaccaaguucacccccgugggcgugguccaggacgggaacggcacccaccagaacgagccccagcagugggugcugcccuccuacagcggccggacggggcacaacgugcaccucgccccggccgucgcccccaccuuccccggcgagcagcugcuguucuuccgcagcaccaugcccgggugcuccggcuacccgaacaugaaccucgacugccugcugccccaggagugggugcagcacuucuaccaggaggccgcgcccgcccagagcgacguggcccuccugcgguucgucaaccccgacaccgggcgcgugcuguucgagugcaagcuccacaaguccggcuacgugaccgucgcccacacgggccagcacgaccuggugaucccgcccaacggguacuuccgguucgacagcugggugaaccaguucuacacccuggcgccccucggcaacgggaccggccgccggcgcgcccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39717 - RNA, 1623 nt, Artificial Sequence
  derived and/or modified sequence opt from capsid_protein__Norovirus__AFN70960.1
augaagauggccagcaaggacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccggcggcgaguucaccguguccccgcggaacgcccccggggagauccuguggagcgcgccccuggggccggaccucaaccccuaccugucccaccuggcccgcauguacaacggcuacgccgggggcuucgaggugcaggucauccucgccgggaacgccuucacggcgggcaaggugaucuucgccgccgugccgcccaacuuccccaccgaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggccaacaacgcgggcgaggacgucuucaccguguccugccgcgugcugacccggccgagccccgacuucgacuucaucuuccucgucccgcccaccguggagucccgcacgaagccguucaccgugcccauccugaccgucgaggagaugaccaacagccgguuccccaucccccuggagaagcucuucacgggcccguccggggccuucgugguccagccccagaacggccgcugcaccaccgacggggugcugcugggcaccacgcagcucagccccgugaacaucugcaccuuccggggcgacgucacccacaucgccgggacccacaacuacacgaugaaccuggccucccagaacuggaacaacuacgacccgaccgaggagauccccgccccgcugggcacccccgacuucguggggcgcauccagggcaugcucacccagacgacccggggcgacgggagcacccgcggccacaaggcgaccguguccacgggggacguccacuucaccccgaagcugggcagcauccaguucaacaccgacaccaacaacgacuucgagacggggcagaacaccaaguucacccccgugggcgugguccaggacgggaacggcacccaccagaacgagccccagcagugggugcugcccuccuacagcggccggacggggcacaacgugcaccucgccccggccgucgcccccaccuuccccggcgagcagcugcuguucuuccgcagcaccaugcccgggugcuccggcuacccgaacaugaaccucgacugccugcugccccaggagugggugcagcacuucuaccaggaggccgcgcccgcccagagcgacguggcccuccugcgguucgucaaccccgacaccgggcgcgugcuguucgagugcaagcuccacaaguccggcuacgugaccgucgcccacacgggccagcacgaccuggugaucccgcccaacggguacuuccgguucgacagcugggugaaccaguucuacacccuggcgccccucggcaacgggaccggccgccggcgcgcccuguga

SEQ ID NO: 39718 - RNA, 1840 nt, Artificial Sequence
  mRNA product wild type from capsid_protein__Norovirus__AAR97663.1
gggagaaagcuuaccaugaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaauuaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39719 - RNA, 2005 nt, Artificial Sequence
  mRNA product wild type from capsid_protein__Norovirus__AAR97663.1
ggggcgcugccuacggagguggcagccaucuccuucucggcaucaagcuuaccaugaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaauuaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39720 - RNA, 1840 nt, Artificial Sequence
  mRNA product opt1 from capsid_protein__Norovirus__AAR97663.1
gggagaaagcuuaccaugaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagcugaacgaccccaccaucaagcucaucgccaugcuguacacgccccugcgggccaacaacgcgggcgaggacguguucaccgugagcugccgcguccucacccggccgucccccgacuucgacuucaucuuccuggugccgcccaccguggagagccgcacgaagcccuucaccguccccauccugaccguggaggagaugaccaacucccgguuccccaucccccucgagaagcuguucacgggcccgagcggggccuucgugguccagccccagaacggccgcugcaccaccgacggggugcugcucggcaccacgcagcugucccccgucaacaucugcaccuuccggggcgacgugacccacaucgccgggacccacaacuacacgaugaaccuggccagccagaacuggaacaacuacgacccgaccgaggagauccccgcgccccucggcacccccgacuucguggggcgcauccagggcaugcugacccagacgacccgcggggacggcuccacccggggccacaaggccaccgucagcacgggggacgugcacuucaccccgaagcugggcuccauccaguucaacaccgacaccaacaacgacuucgagacggggcagaacaccaaguucacccccgugggcgucgugcaggacgggaacggcacccaccagaacgagccccagcagugggugcuccccagcuacuccggccggacggggcacaacguccaccuggccccggccguggcccccaccuuccccggcgagcagcuccucuucuuccgcagcaccaugcccgggugcagcggcuacccgaacaugaaccuggacugccugcucccccaggagugggugcagcacuucuaccaggaggccgcgcccgcccaguccgacgucgcccugcugcgguucgugaaccccgacaccgggcgcgugcuguucgagugcaagcugcacaagagcggcuacgucaccguggcccacacgggccagcacgaccuggugaucccgcccaacggguacuuccgguucgacuccugggucaaccaguucuacacccucgcgcccaugggcaacgggaccggccgccggcgcgcccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39721 - RNA, 2005 nt, Artificial Sequence
  mRNA product opt1 from capsid_protein__Norovirus__AAR97663.1
ggggcgcugccuacggagguggcagccaucuccuucucggcaucaagcuuaccaugaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagcugaacgaccccaccaucaagcucaucgccaugcuguacacgccccugcgggccaacaacgcgggcgaggacguguucaccgugagcugccgcguccucacccggccgucccccgacuucgacuucaucuuccuggugccgcccaccguggagagccgcacgaagcccuucaccguccccauccugaccguggaggagaugaccaacucccgguuccccaucccccucgagaagcuguucacgggcccgagcggggccuucgugguccagccccagaacggccgcugcaccaccgacggggugcugcucggcaccacgcagcugucccccgucaacaucugcaccuuccggggcgacgugacccacaucgccgggacccacaacuacacgaugaaccuggccagccagaacuggaacaacuacgacccgaccgaggagauccccgcgccccucggcacccccgacuucguggggcgcauccagggcaugcugacccagacgacccgcggggacggcuccacccggggccacaaggccaccgucagcacgggggacgugcacuucaccccgaagcugggcuccauccaguucaacaccgacaccaacaacgacuucgagacggggcagaacaccaaguucacccccgugggcgucgugcaggacgggaacggcacccaccagaacgagccccagcagugggugcuccccagcuacuccggccggacggggcacaacguccaccuggccccggccguggcccccaccuuccccggcgagcagcuccucuucuuccgcagcaccaugcccgggugcagcggcuacccgaacaugaaccuggacugccugcucccccaggagugggugcagcacuucuaccaggaggccgcgcccgcccaguccgacgucgcccugcugcgguucgugaaccccgacaccgggcgcgugcuguucgagugcaagcugcacaagagcggcuacgucaccguggcccacacgggccagcacgaccuggugaucccgcccaacggguacuuccgguucgacuccugggucaaccaguucuacacccucgcgcccaugggcaacgggaccggccgccggcgcgcccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39722 - RNA, 1810 nt, Artificial Sequence
  mRNA product wild type from capsid_protein_VP1__Norovirus__AGM33208
gggagaaagcuuaccaugaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagagguaggcuuggucugcgccgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39723 - RNA, 1975 nt, Artificial Sequence
  mRNA product wild type from capsid_protein_VP1__Norovirus__AGM33208
ggggcgcugccuacggagguggcagccaucuccuucucggcaucaagcuuaccaugaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagagguaggcuuggucugcgccgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39724 - RNA, 1810 nt, Artificial Sequence
  mRNA product opt from capsid_protein_VP1__Norovirus__AGM33208
gggagaaagcuuaccaugaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucaccgaggccacgcaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccaccgucggcgaggccgcccuccugcacuacguggaccccgacaccgggcggaaccugggcgaguucaaggccuaccccgacggcuuccugaccugcgugccgaacggggccuccagcggcccccagcagcuccccaucaacggggucuucguguucgugagcugggucucccgcuucuaccagcugaagcccgugggcacggcgagcuccgcccgggggcgccucggccugcggcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39725 - RNA, 1975 nt, Artificial Sequence
  R5757/R5758 mRNA product opt fromcapsid_protein_VP1__Norovirus__AGM33208
ggggcgcugccuacggagguggcagccaucuccuucucggcaucaagcuuaccaugaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucaccgaggccacgcaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccaccgucggcgaggccgcccuccugcacuacguggaccccgacaccgggcggaaccugggcgaguucaaggccuaccccgacggcuuccugaccugcgugccgaacggggccuccagcggcccccagcagcuccccaucaacggggucuucguguucgugagcugggucucccgcuucuaccagcugaagcccgugggcacggcgagcuccgcccgggggcgccucggccugcggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39726 - RNA, 1840 nt, Artificial Sequence
  mRNA product wild type from major_capsid_protein__Norovirus__AGS41450
gggagaaagcuuaccaugaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggaucagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguagauguuaggcaauuggaaccuguguugauucccuuaccugauguuaggaauaacuucuaucacuauaaucagucaaaugauucuaccauuaaauugauagcaaugcuguacacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaauuuuccgggugaacaacuucucuucuucagguccacuaugcccggaugcagcggguaucccaacacggauuuggauugccuacucccccaggagugggugcagcacuucuaccaagaggcagcuccagcacaaucugauguggcucuauugagauuugugaauccagacacggguagggucuuguuugagugcaaacuucauaaaucagguuaugucacaguggcucacaccggccaacaugauuuggucaucccccccaaugguuauuuuagguuugauuccuggguuaaucaauucuauacacucgcccccaugggaaauggaacggggcguagacgugcauuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39727 - RNA, 2005 nt, Artificial Sequence
  mRNA product wild type from major_capsid_protein__Norovirus__AGS41450
ggggcgcugccuacggagguggcagccaucuccuucucggcaucaagcuuaccaugaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggaucagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguagauguuaggcaauuggaaccuguguugauucccuuaccugauguuaggaauaacuucuaucacuauaaucagucaaaugauucuaccauuaaauugauagcaaugcuguacacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaauuuuccgggugaacaacuucucuucuucagguccacuaugcccggaugcagcggguaucccaacacggauuuggauugccuacucccccaggagugggugcagcacuucuaccaagaggcagcuccagcacaaucugauguggcucuauugagauuugugaauccagacacggguagggucuuguuugagugcaaacuucauaaaucagguuaugucacaguggcucacaccggccaacaugauuuggucaucccccccaaugguuauuuuagguuugauuccuggguuaaucaauucuauacacucgcccccaugggaaauggaacggggcguagacgugcauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39728 - RNA, 1840 nt, Artificial Sequence
  mRNA product opt from major_capsid_protein__Norovirus__AGS41450
gggagaaagcuuaccaugaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcucuucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgcgguggccccgaacuuccccggggagcagcugcucuucuuccgcagcaccaugcccggcugcuccggcuaccccaacacggaccuggacugccugcucccgcaggaguggguccagcacuucuaccaggaggccgcccccgcgcagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39729 - RNA, 2005 nt, Artificial Sequence
  R5759/R5760 mRNA product opt from major_capsid_protein__Norovirus__AGS41450
ggggcgcugccuacggagguggcagccaucuccuucucggcaucaagcuuaccaugaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcucuucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgcgguggccccgaacuuccccggggagcagcugcucuucuuccgcagcaccaugcccggcugcuccggcuaccccaacacggaccuggacugccugcucccgcaggaguggguccagcacuucuaccaggaggccgcccccgcgcagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39730 - RNA, 1623 nt, Artificial Sequence
  derived and/or modified sequence opt from major_capsid_protein__Norovirus__AGS41450
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcucuucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgcgguggccccgaacuuccccggggagcagcugcucuucuuccgcagcaccaugcccggcugcuccggcuaccccaacacggaccuggacugccugcucccgcaggaguggguccagcacuucuaccaggaggccgcccccgcgcagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 39731 - RNA, 1840 nt, Artificial Sequence
  mRNA product wild type from major_viral_capsid_protein__Norovirus__AGC96532
gggagaaagcuuaccaugaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaacuucuaccauuauaaucaaucaaaugacuccaccaucaaguugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaccccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaguuugccacugacacagacaaugauuuugaaacuaaccaaaacacaaaguucaccccagucgguguuauccaggaugguaguacuaccccccgaaaugaaccccaacaaugggugcucccaaguuacucaggcagaaauauucauaaugugcaccuggcccccgcuguagcccccacuuucccgggcgagcagcuucucuucuuuagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39732 - RNA, 2005 nt, Artificial Sequence
  mRNA product wild type from major_viral_capsid_protein__Norovirus__AGC96532
ggggcgcugccuacggagguggcagccaucuccuucucggcaucaagcuuaccaugaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaacuucuaccauuauaaucaaucaaaugacuccaccaucaaguugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaccccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaguuugccacugacacagacaaugauuuugaaacuaaccaaaacacaaaguucaccccagucgguguuauccaggaugguaguacuaccccccgaaaugaaccccaacaaugggugcucccaaguuacucaggcagaaauauucauaaugugcaccuggcccccgcuguagcccccacuuucccgggcgagcagcuucucuucuuuagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39733 - RNA, 1840 nt, Artificial Sequence
  mRNA product opt from major_viral_capsid_protein__Norovirus__AGC96532
gggagaaagcuuaccaugaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcucuucaccggccccagcuccgccuucgucgugcagccgcagaacgggcgcugcacgaccgacggcguccugcuggggaccacccagcucagccccgugaacaucugcacguuccggggcgacgugacccacauccccggcucccgcaacuacaccaugaaccuggccagccagaacuggaacagcuacgacccgaccgaggagacgcccgcgccccuggggacccccgacuucgucggcaagauccagggggugcucacccagaccacgcggaccaacggcuccacccgcgggcacaaggccaccguguacacgggcagcgccgacuucuccccgaagcugggccggguccaguucgccaccgacaccgacaacgacuucgagaccaaccagaacacgaaguucacccccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccgccgggcccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39734 - RNA, 2005 nt, Artificial Sequence
  R5761/R5762 mRNA product opt from major_viral_capsid_protein__Norovirus__AGC96532
ggggcgcugccuacggagguggcagccaucuccuucucggcaucaagcuuaccaugaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcucuucaccggccccagcuccgccuucgucgugcagccgcagaacgggcgcugcacgaccgacggcguccugcuggggaccacccagcucagccccgugaacaucugcacguuccggggcgacgugacccacauccccggcucccgcaacuacaccaugaaccuggccagccagaacuggaacagcuacgacccgaccgaggagacgcccgcgccccuggggacccccgacuucgucggcaagauccagggggugcucacccagaccacgcggaccaacggcuccacccgcgggcacaaggccaccguguacacgggcagcgccgacuucuccccgaagcugggccggguccaguucgccaccgacaccgacaacgacuucgagaccaaccagaacacgaaguucacccccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccgccgggcccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39735 - RNA, 1837 nt, Artificial Sequence
  mRNA product wild type from major_capsid_protein__Norovirus__AFJ04707
gggagaaagcuuaccaugaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguguccccuagaaacgcuccgggugagauacuauggagcgcgcccuugggcccugauuugaaccccuaccuuucucauuuagccagaauguacaaugguuaugcaggugguuuugaagugcagguaauccuugcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaugacgucuucacagucucuugucgaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguacacgggucccagcagugcuuuuguuguccaaccacaaaauggcaggugcacgacugauggcgugcucuugggcaccacccagcugucugcugucaacaucugcaccuucagaggggauaucacucacauugcaggcagucaugacuauacaaugaaucuggcuucucaaaauuggagcaauuaugacccaacagaagaaaucccagccccucugggaacuccagacuucgugggaaagauccaaggcaugcucacccaaaccacaagagaggauggcucgacccgcgcccacaaagccacagugagcacugggaguguccacuuuacuccaaagcugggcaguguucaauacaccacugacacaaacaaugauuuucaaacuggccaaaacacaaaauucaccccagucggcgucauccaggacggugguaaccaucaaaaugaaccccaacaauggguacucccaaauuauucagguagaacuggucauaaugugcaccuagcuccugccguugcccccacuuucccgggugaacaacuucucuucuuuagguccacuaugcccgggugcagcggguaucccaacaugaaucuggauugccuacuuccccaggaaugggugcaacacuucuaucaagaagcagccccagcacaaucugauguggcccugcugagauuugugaauccagacacagguaggguuuuguuugagugcaaacuucauaaaucaggcuauguuacaguggcucacacugguccgcaugaucugguuaucccccccaaugguuacuucagauuugauuccugggucaaccaguucuacacacuugcccccaugggaaauggagcggggcguagacgugcauuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39736 - RNA, 2002 nt, Artificial Sequence
  mRNA product wild type from major_capsid_protein__Norovirus__AFJ04707
ggggcgcugccuacggagguggcagccaucuccuucucggcaucaagcuuaccaugaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguguccccuagaaacgcuccgggugagauacuauggagcgcgcccuugggcccugauuugaaccccuaccuuucucauuuagccagaauguacaaugguuaugcaggugguuuugaagugcagguaauccuugcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaugacgucuucacagucucuugucgaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguacacgggucccagcagugcuuuuguuguccaaccacaaaauggcaggugcacgacugauggcgugcucuugggcaccacccagcugucugcugucaacaucugcaccuucagaggggauaucacucacauugcaggcagucaugacuauacaaugaaucuggcuucucaaaauuggagcaauuaugacccaacagaagaaaucccagccccucugggaacuccagacuucgugggaaagauccaaggcaugcucacccaaaccacaagagaggauggcucgacccgcgcccacaaagccacagugagcacugggaguguccacuuuacuccaaagcugggcaguguucaauacaccacugacacaaacaaugauuuucaaacuggccaaaacacaaaauucaccccagucggcgucauccaggacggugguaaccaucaaaaugaaccccaacaauggguacucccaaauuauucagguagaacuggucauaaugugcaccuagcuccugccguugcccccacuuucccgggugaacaacuucucuucuuuagguccacuaugcccgggugcagcggguaucccaacaugaaucuggauugccuacuuccccaggaaugggugcaacacuucuaucaagaagcagccccagcacaaucugauguggcccugcugagauuugugaauccagacacagguaggguuuuguuugagugcaaacuucauaaaucaggcuauguuacaguggcucacacugguccgcaugaucugguuaucccccccaaugguuacuucagauuugauuccugggucaaccaguucuacacacuugcccccaugggaaauggagcggggcguagacgugcauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39737 - RNA, 1837 nt, Artificial Sequence
  mRNA product opt from major_capsid_protein__Norovirus__AFJ04707
gggagaaagcuuaccaugaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacaucacccacaucgccggcucccacgacuacaccaugaaccuggccagccagaacuggagcaacuacgaccccaccgaggagauccccgcgccgcuggggacgcccgacuucgugggcaagauccaggggaugcucacccagaccacccgcgaggacggcuccacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcgggaaccaccagaacgagccgcagcagugggugcugcccaacuacuccggccgcaccgggcacaacgugcaccucgcccccgccgucgcgcccaccuucccgggcgagcagcugcuguucuuccggagcacgaugcccggcugcuccggguaccccaacaugaaccucgacugccugcugccccaggagugggugcagcacuucuaccaggaggccgccccggcccagagcgacguggcgcuccugcgcuucgucaaccccgacaccggccgggugcuguucgagugcaagcuccacaaguccggguacgugaccgucgcccacaccggcccccacgaccuggugaucccgcccaacggguacuuccgcuucgacagcugggugaaccaguucuacacccuggcccccaugggcaacggcgccgggcggcgccgggcccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39738 - RNA, 2002 nt, Artificial Sequence
  R5763/R5764 mRNA product opt from major_capsid_protein__Norovirus__AFJ04707
ggggcgcugccuacggagguggcagccaucuccuucucggcaucaagcuuaccaugaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacaucacccacaucgccggcucccacgacuacaccaugaaccuggccagccagaacuggagcaacuacgaccccaccgaggagauccccgcgccgcuggggacgcccgacuucgugggcaagauccaggggaugcucacccagaccacccgcgaggacggcuccacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcgggaaccaccagaacgagccgcagcagugggugcugcccaacuacuccggccgcaccgggcacaacgugcaccucgcccccgccgucgcgcccaccuucccgggcgagcagcugcuguucuuccggagcacgaugcccggcugcuccggguaccccaacaugaaccucgacugccugcugccccaggagugggugcagcacuucuaccaggaggccgccccggcccagagcgacguggcgcuccugcgcuucgucaaccccgacaccggccgggugcuguucgagugcaagcuccacaaguccggguacgugaccgucgcccacaccggcccccacgaccuggugaucccgcccaacggguacuuccgcuucgacagcugggugaaccaguucuacacccuggcccccaugggcaacggcgccgggcggcgccgggcccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39739 - RNA, 1846 nt, Artificial Sequence
  mRNA product wild type from VP1__Norovirus_and/or_Norovirus-like__X81879
gggagaaagcuuaccaugaagauggcgucgaaugacgccgcuccaucuacugauggugcagccggccucgugccagaaaguaauaaugaggucauggcucuugaacccguggcuggcgccgccuuggcagccccggucaccggucaaacaaauauaauagacccuuggauuagagcaaauuuuguccaggccccuaauggugaauuuacaguuucuccccgcaaugccccuggugaagugcuauugaaucuagaguuggguccagaauugaauccuuaucuggcacauuuagcaagaauguauaacggguaugccggugggauggaggugcaggucauguuggcugggaacgcguucacagccggcaaauuggucuucgccgcugugccaccucauuuuccggucgaaaaccuuaguccacagaaaauuaccauguucccccaugugauuauagauguaaggacuuuagaaccuguuuuauuaccacucccugauguuagaaauaguuucuuccauuauaaccaaaaagaugaucccaagaugagaauuguggcuaugcuuuacaccccccuuagguccaaugguucaggugaugacguguuuacagucucuugcaggguguugaccagaccuuccccugauuuugauuuuacauaccugguaccaccaacaguggaauccaaaacaaaaccauucacccuuccaauccucacgcuuggggagcuuuccaauucuagguucccagugcccauagaucagauguauacuagccccaaugaagucauaucugugcagugucagaauggaaggugcacgcuggauggggagcuccaaggaacaacacagcuccaagucaguggcauuugugcauucaaaggagaagugaccgcucacuugcaugacaaugaucaccuaaauaaugucaccaucacaaacuugaauggguccccuuuugaucccuccgaggacauccccgcccccuugggcgugccugacuuccaggggagagucuuuggugucaucucccaaagagacaaacagaaugccgcuggacacagugagccagcaaacaggggacacgaugcugugguucccacuuacacagcacaguacacuccaaaauugggucagauucaaauuggcacauggcagaccgacgaccuuacagucaaccaaccagucaaauucaccccaguuggucucaaugacacagaacauuuuaaccaguggguggucccuagauacgcuggugccuuaaaccuuaacacaaaucuugcccccucuguugcuccaguguuuccaggggagcgccugcucuucuucagaucacaccucccccuuaaggguggcuauggaaauccagcuauugauugucuacugccacaagagugggugcagcauuuuuaucaagaagcagcucccucaaugagugagguggcccuugucagauacaucaauccagacacuggccgggcgcuguuugaggccaagcuccacagagcugguuucaugacagucucaagcaacaccagugcuccggugguugugccugccaacggauacuucagguuugacucuugggugaaccaauuuuauucucucgcccccaugggaacuggaaaugggcguagaaggguucaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39740 - RNA, 2011 nt, Artificial Sequence
  mRNA product wild type from VP1__Norovirus_and/or_Norovirus-like__X81879
ggggcgcugccuacggagguggcagccaucuccuucucggcaucaagcuuaccaugaagauggcgucgaaugacgccgcuccaucuacugauggugcagccggccucgugccagaaaguaauaaugaggucauggcucuugaacccguggcuggcgccgccuuggcagccccggucaccggucaaacaaauauaauagacccuuggauuagagcaaauuuuguccaggccccuaauggugaauuuacaguuucuccccgcaaugccccuggugaagugcuauugaaucuagaguuggguccagaauugaauccuuaucuggcacauuuagcaagaauguauaacggguaugccggugggauggaggugcaggucauguuggcugggaacgcguucacagccggcaaauuggucuucgccgcugugccaccucauuuuccggucgaaaaccuuaguccacagaaaauuaccauguucccccaugugauuauagauguaaggacuuuagaaccuguuuuauuaccacucccugauguuagaaauaguuucuuccauuauaaccaaaaagaugaucccaagaugagaauuguggcuaugcuuuacaccccccuuagguccaaugguucaggugaugacguguuuacagucucuugcaggguguugaccagaccuuccccugauuuugauuuuacauaccugguaccaccaacaguggaauccaaaacaaaaccauucacccuuccaauccucacgcuuggggagcuuuccaauucuagguucccagugcccauagaucagauguauacuagccccaaugaagucauaucugugcagugucagaauggaaggugcacgcuggauggggagcuccaaggaacaacacagcuccaagucaguggcauuugugcauucaaaggagaagugaccgcucacuugcaugacaaugaucaccuaaauaaugucaccaucacaaacuugaauggguccccuuuugaucccuccgaggacauccccgcccccuugggcgugccugacuuccaggggagagucuuuggugucaucucccaaagagacaaacagaaugccgcuggacacagugagccagcaaacaggggacacgaugcugugguucccacuuacacagcacaguacacuccaaaauugggucagauucaaauuggcacauggcagaccgacgaccuuacagucaaccaaccagucaaauucaccccaguuggucucaaugacacagaacauuuuaaccaguggguggucccuagauacgcuggugccuuaaaccuuaacacaaaucuugcccccucuguugcuccaguguuuccaggggagcgccugcucuucuucagaucacaccucccccuuaaggguggcuauggaaauccagcuauugauugucuacugccacaagagugggugcagcauuuuuaucaagaagcagcucccucaaugagugagguggcccuugucagauacaucaauccagacacuggccgggcgcuguuugaggccaagcuccacagagcugguuucaugacagucucaagcaacaccagugcuccggugguugugccugccaacggauacuucagguuugacucuugggugaaccaauuuuauucucucgcccccaugggaacuggaaaugggcguagaaggguucaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39741 - RNA, 1846 nt, Artificial Sequence
  mRNA product opt from VP1__Norovirus_and/or_Norovirus-like__X81879
gggagaaagcuuaccaugaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgcggggaacgccuucaccgccggcaagcugguguucgccgcggucccgccccacuuccccguggagaaccugagcccccagaagaucaccauguucccccacgugaucaucgacguccggacgcucgagcccgugcugcugccccucccggacgugcgcaacuccuucuuccacuacaaccagaaggacgaccccaagaugcggaucgucgccaugcuguacacgccccugcgcagcaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccguccccaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccugaacaacgucaccaucaccaaccugaacgggagcccguucgaccccuccgaggacauccccgccccgcucggcgugcccgacuuccaggggcggguguucggcgucaucagccagcgcgacaagcagaacgcggccgggcacuccgagcccgccaaccggggccacgacgccguggugcccacguacaccgcccaguacaccccgaagcugggccagauccagaucgggaccuggcagacggacgaccugaccgucaaccagcccgugaaguucacccccgugggccucaacgacaccgagcacuucaaccagugggucgugccccgcuacgcgggggcccugaaccugaacacgaaccucgccccgagcguggcccccgucuuccccggcgagcggcugcuguucuuccgcagccaccucccccugaagggcggguacggcaacccggcgaucgacugccugcucccccaggagugggugcagcacuucuaccaggaggccgcccccuccaugagcgagguggcccugguccgguacaucaaccccgacaccgggcgcgcccuguucgaggcgaagcuccaccgggccggcuucaugaccguguccagcaacaccuccgccccgguggucgugcccgccaacggguacuuccgcuucgacagcugggugaaccaguucuacucccuggcccccaugggcacggggaacggccggcgccgcguccagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39742 - RNA, 2011 nt, Artificial Sequence
  mRNA product opt from VP1__Norovirus_and/or_Norovirus-like__X81879
ggggcgcugccuacggagguggcagccaucuccuucucggcaucaagcuuaccaugaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgcggggaacgccuucaccgccggcaagcugguguucgccgcggucccgccccacuuccccguggagaaccugagcccccagaagaucaccauguucccccacgugaucaucgacguccggacgcucgagcccgugcugcugccccucccggacgugcgcaacuccuucuuccacuacaaccagaaggacgaccccaagaugcggaucgucgccaugcuguacacgccccugcgcagcaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccguccccaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccugaacaacgucaccaucaccaaccugaacgggagcccguucgaccccuccgaggacauccccgccccgcucggcgugcccgacuuccaggggcggguguucggcgucaucagccagcgcgacaagcagaacgcggccgggcacuccgagcccgccaaccggggccacgacgccguggugcccacguacaccgcccaguacaccccgaagcugggccagauccagaucgggaccuggcagacggacgaccugaccgucaaccagcccgugaaguucacccccgugggccucaacgacaccgagcacuucaaccagugggucgugccccgcuacgcgggggcccugaaccugaacacgaaccucgccccgagcguggcccccgucuuccccggcgagcggcugcuguucuuccgcagccaccucccccugaagggcggguacggcaacccggcgaucgacugccugcucccccaggagugggugcagcacuucuaccaggaggccgcccccuccaugagcgagguggcccugguccgguacaucaaccccgacaccgggcgcgcccuguucgaggcgaagcuccaccgggccggcuucaugaccguguccagcaacaccuccgccccgguggucgugcccgccaacggguacuuccgcuucgacagcugggugaaccaguucuacucccuggcccccaugggcacggggaacggccggcgccgcguccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39743 - RNA, 1846 nt, Artificial Sequence
  mRNA product wild type from capsid_protein__Norovirus__BAG68716
gggagaaagcuuaccaugaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucaugcuggcugggaacgcguucacagccggcaaguuggucuucgccgcugugccaccucacuucccgguugaaaaccuuaguccacagcaaauuaccauguucccucaugugauuauagaugugaggaccuuggaaccuguuuuauuaccacucccugauguuagaaacaauuucuuccacuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggaaucuaaaacaaaaccauucacccucccaauccucacacuuggggaacucucuaauucuagauucccaguguccauagaccagauguacaccagccccaaugaaguuauaucagugcagugucaaaaugguaggugcacacuggauggggaacuccaagggacaacacaacuacaagucaguggcauuugugcuuucaagggagaagugaccgcccacuugcaugacaaugaucaccuauauaaugucaccaucacaaacuugaauggguccccuuuugaccccuccgaggacaucccugccccucugggugugccugacuuucaaggaaggguuuuugguaucaucucccaaagagacaaacacaauagcccuggacauaaugaaccagcaaacaggggacacgacgcuguagucccuacuuacacagcacaguacacuccaaaauugggucagauucaaauuggcacauggcagaccgacgaucuuacagucaaccaaccaguuaaauucaccccaguuggacucaaugauacugaacauuuuaaccaaugggugguucccagauaugcuggugcccuaaaccucaacacaaaccuugccccuucuguugcuccaguauuuccaggggagcgccugcucuucuucagaucauacauuccccucaagggugguuauggaaauccagccauugauugccuacuaccacaagagugggugcaacauuucuaucaggaagcagccccuucaaugagugagguggcccuugucagauacaucaacccggauacuggucgggcacuguuugaggccaagcuccacagagcuggcuucaugacagucucaagcaacaccagugccccggugguugugccugccaauggauacuucagauuugauucuugggugaaccaauucuauucucucgcccccaugggaacuggaaaugggcguagaaggguucaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39744 - RNA, 2011 nt, Artificial Sequence
  mRNA product wild type from capsid_protein__Norovirus__BAG68716
ggggcgcugccuacggagguggcagccaucuccuucucggcaucaagcuuaccaugaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucaugcuggcugggaacgcguucacagccggcaaguuggucuucgccgcugugccaccucacuucccgguugaaaaccuuaguccacagcaaauuaccauguucccucaugugauuauagaugugaggaccuuggaaccuguuuuauuaccacucccugauguuagaaacaauuucuuccacuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggaaucuaaaacaaaaccauucacccucccaauccucacacuuggggaacucucuaauucuagauucccaguguccauagaccagauguacaccagccccaaugaaguuauaucagugcagugucaaaaugguaggugcacacuggauggggaacuccaagggacaacacaacuacaagucaguggcauuugugcuuucaagggagaagugaccgcccacuugcaugacaaugaucaccuauauaaugucaccaucacaaacuugaauggguccccuuuugaccccuccgaggacaucccugccccucugggugugccugacuuucaaggaaggguuuuugguaucaucucccaaagagacaaacacaauagcccuggacauaaugaaccagcaaacaggggacacgacgcuguagucccuacuuacacagcacaguacacuccaaaauugggucagauucaaauuggcacauggcagaccgacgaucuuacagucaaccaaccaguuaaauucaccccaguuggacucaaugauacugaacauuuuaaccaaugggugguucccagauaugcuggugcccuaaaccucaacacaaaccuugccccuucuguugcuccaguauuuccaggggagcgccugcucuucuucagaucauacauuccccucaagggugguuauggaaauccagccauugauugccuacuaccacaagagugggugcaacauuucuaucaggaagcagccccuucaaugagugagguggcccuugucagauacaucaacccggauacuggucgggcacuguuugaggccaagcuccacagagcuggcuucaugacagucucaagcaacaccagugccccggugguugugccugccaauggauacuucagauuugauucuugggugaaccaauucuauucucucgcccccaugggaacuggaaaugggcguagaaggguucaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39745 - RNA, 1846 nt, Artificial Sequence
  mRNA product opt from capsid_protein__Norovirus__BAG68716
gggagaaagcuuaccaugaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcaucaucagccagcgcgacaagcacaacucccccgggcacaacgagcccgcgaaccggggccacgacgccgucgugcccacguacaccgcccaguacaccccgaagcugggccagauccagaucgggaccuggcagacggacgaccugaccgugaaccagcccgucaaguucacccccgugggccucaacgacaccgagcacuucaaccaguggguggucccccgcuacgccggggcccugaaccugaacacgaaccucgcgccgagcguggcccccguguuccccggcgagcggcugcuguucuuccgcagcuacaucccccucaagggcggguacggcaacccggccaucgacugccugcugccccaggaguggguccagcacuucuaccaggaggccgcgcccuccaugagcgagguggcccucgugcgguacaucaaccccgacaccgggcgcgcccuguucgaggccaagcugcaccgggccggcuucaugaccgucuccagcaacaccuccgcgccgguggugguccccgccaacggguacuuccgcuucgacagcugggugaaccaguucuacucccucgcccccaugggcacggggaacggccggcgccgcgugcagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 39746 - RNA, 2011 nt, Artificial Sequence
  mRNA product opt from capsid_protein__Norovirus__BAG68716
ggggcgcugccuacggagguggcagccaucuccuucucggcaucaagcuuaccaugaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcaucaucagccagcgcgacaagcacaacucccccgggcacaacgagcccgcgaaccggggccacgacgccgucgugcccacguacaccgcccaguacaccccgaagcugggccagauccagaucgggaccuggcagacggacgaccugaccgugaaccagcccgucaaguucacccccgugggccucaacgacaccgagcacuucaaccaguggguggucccccgcuacgccggggcccugaaccugaacacgaaccucgcgccgagcguggcccccguguuccccggcgagcggcugcuguucuuccgcagcuacaucccccucaagggcggguacggcaacccggccaucgacugccugcugccccaggaguggguccagcacuucuaccaggaggccgcgcccuccaugagcgagguggcccucgugcgguacaucaaccccgacaccgggcgcgcccuguucgaggccaagcugcaccgggccggcuucaugaccgucuccagcaacaccuccgcgccgguggugguccccgccaacggguacuuccgcuucgacagcugggugaaccaguucuacucccucgcccccaugggcacggggaacggccggcgccgcgugcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
